US009139648B1

(12) United States Patent
Clube

(10) Patent No.: US 9,139,648 B1
(45) Date of Patent: Sep. 22, 2015

(54) PRECISION MEDICINE BY TARGETING HUMAN NAV1.9 VARIANTS FOR TREATMENT OF PAIN

(71) Applicant: Kymab Limited, Cambridge (GB)

(72) Inventor: Jasper Rupert Clube, Cambridge (GB)

(73) Assignee: Kymab Limited, Cambridge (GB)

( * ) Notice: Subject to any disclaimer, the term of this patent is extended or adjusted under 35 U.S.C. 154(b) by 0 days.

(21) Appl. No.: 14/665,579

(22) Filed: Mar. 23, 2015

Related U.S. Application Data

(63) Continuation-in-part of application No. 14/331,730, filed on Jul. 15, 2014.

(51) Int. Cl.
| | |
|---|---|
| A61K 39/395 | (2006.01) |
| C07K 16/28 | (2006.01) |
| C12Q 1/68 | (2006.01) |
| A61K 45/06 | (2006.01) |
| A61K 39/00 | (2006.01) |

(52) U.S. Cl.
CPC ............ C07K 16/28 (2013.01); A61K 39/3955 (2013.01); A61K 45/06 (2013.01); C12Q 1/6883 (2013.01); A61K 2039/505 (2013.01); C12Q 2600/156 (2013.01)

(58) Field of Classification Search
None
See application file for complete search history.

(56) References Cited

U.S. PATENT DOCUMENTS

| | | | |
|---|---|---|---|
| 5,545,807 | A | 8/1996 | Surani et al. |
| 5,766,886 | A | 6/1998 | Studnicka et al. |
| 5,869,619 | A | 2/1999 | Studnicka |
| 6,875,432 | B2 | 4/2005 | Liu et al. |
| 7,029,895 | B2 | 4/2006 | Glucksmann et al. |
| 7,129,338 | B1 | 10/2006 | Ota et al. |
| 7,261,893 | B2 | 8/2007 | Veldman et al. |
| 7,300,754 | B2 | 11/2007 | Abi Fadel et al. |
| 7,368,531 | B2 | 5/2008 | Rosen et al. |
| 7,411,051 | B2 | 8/2008 | Rosen et al. |
| 7,456,264 | B2 | 11/2008 | Keler et al. |
| 7,482,147 | B2 | 1/2009 | Glucksmann et al. |
| 7,572,618 | B2 | 8/2009 | Mintier et al. |
| 7,776,577 | B2 | 8/2010 | Kapeller-Libermann et al. |
| 7,968,689 | B2 | 6/2011 | Rosen et al. |
| 7,972,813 | B2 * | 7/2011 | McCormack et al. ....... 435/70.1 |
| 8,030,457 | B2 | 10/2011 | Jackson et al. |
| 8,062,640 | B2 | 11/2011 | Sleeman et al. |
| 8,080,243 | B2 | 12/2011 | Liang et al. |
| 8,168,762 | B2 | 5/2012 | Jackson et al. |
| 8,188,233 | B2 | 5/2012 | Condra et al. |
| 8,188,234 | B2 | 5/2012 | Condra et al. |
| 8,344,114 | B2 | 1/2013 | Sparrow et al. |
| 8,357,371 | B2 | 1/2013 | Sleeman et al. |
| 8,399,646 | B2 | 3/2013 | Liang et al. |
| 8,420,098 | B2 | 4/2013 | Camphausen et al. |
| 8,426,363 | B2 | 4/2013 | Liang et al. |
| 8,501,184 | B2 | 8/2013 | Sleeman et al. |
| 8,530,414 | B2 | 9/2013 | Davies et al. |
| 8,563,698 | B2 | 10/2013 | Jackson et al. |
| 8,598,320 | B2 | 12/2013 | Hedrick |
| 2002/0045571 | A1 | 4/2002 | Liu et al. |
| 2002/0064555 | A1 | 5/2002 | Cullen et al. |
| 2002/0081679 | A1 | 6/2002 | Chiang et al. |
| 2003/0119038 | A1 | 6/2003 | Bingham et al. |
| 2004/0009553 | A1 | 1/2004 | Glucksmann et al. |
| 2004/0023243 | A1 | 2/2004 | Henry |
| 2004/0038242 | A1 | 2/2004 | Edmonds et al. |
| 2004/0248177 | A1 | 12/2004 | Abi Fadel et al. |
| 2005/0101529 | A1 | 5/2005 | Yue et al. |
| 2005/0118625 | A1 | 6/2005 | Mounts |
| 2005/0147612 | A1 | 7/2005 | Yayon et al. |
| 2005/0197285 | A1 | 9/2005 | Rosen et al. |
| 2006/0116508 | A1 | 6/2006 | Glucksmann et al. |
| 2006/0147945 | A1 | 7/2006 | Edmonds et al. |
| 2006/0223088 | A1 | 10/2006 | Rosen et al. |
| 2006/0223090 | A1 | 10/2006 | Rosen et al. |
| 2006/0246483 | A1 | 11/2006 | Rosen et al. |
| 2007/0015696 | A1 | 1/2007 | Rosen et al. |
| 2007/0037206 | A1 | 2/2007 | Rosen et al. |
| 2007/0041963 | A1 | 2/2007 | Rosen |
| 2007/0055056 | A1 | 3/2007 | Rosen et al. |
| 2007/0082345 | A1 | 4/2007 | Ota et al. |
| 2007/0224663 | A1 | 9/2007 | Rosen et al. |
| 2008/0008697 | A1 | 1/2008 | Mintier et al. |
| 2008/0103090 | A1 | 5/2008 | Rosen et al. |
| 2008/0113930 | A1 | 5/2008 | Tan et al. |
| 2009/0142352 | A1 | 6/2009 | Jackson et al. |
| 2009/0232795 | A1 | 9/2009 | Condra et al. |
| 2009/0246192 | A1 | 10/2009 | Condra et al. |
| 2009/0269350 | A1 | 10/2009 | Glucksmann et al. |
| 2009/0326202 | A1 | 12/2009 | Jackson et al. |

(Continued)

FOREIGN PATENT DOCUMENTS

| | | |
|---|---|---|
| EP | 1067182 | 1/2001 |
| EP | 1514933 | 3/2005 |

(Continued)

OTHER PUBLICATIONS

Benn et al, Journal of the American College of Cardiology, vol. 55, No. 25, 2010, pp. 2833-2842.
Homer et al, Atherosclerosis, vol. 196, 2008, pp. 659-666.
Kotowski et al, The American Journal of Human Genetics, vol. 78, 2006, pp. 410-422.
Miyake et al, Atherosclerosis, vol. 196, 2008, pp. 29-36.
Abboud et al., "Proprotein convertase subtilisin/kexin type 9 (PCSK9) gene is a risk factor of large-vessel atherosclerosis stroke" PLoS One, 2(10):e1043, (2007).

(Continued)

*Primary Examiner* — Sharon Wen

(74) *Attorney, Agent, or Firm* — Nixon Peabody LLP, David S. Resnick; Leena H. Karttunen Contarino; Nicole Kling

(57) ABSTRACT

The invention relates to human targets of interest (TOI), anti-TOI ligands, kits compositions and method.

24 Claims, 5 Drawing Sheets

(56) References Cited

U.S. PATENT DOCUMENTS

| | | |
|---|---|---|
| 2010/0040610 A1 | 2/2010 | Sitlani et al. |
| 2010/0040611 A1 | 2/2010 | Sparrow et al. |
| 2010/0041102 A1 | 2/2010 | Sitlani et al. |
| 2010/0068194 A1 | 3/2010 | Kim |
| 2010/0068199 A1 | 3/2010 | Liang et al. |
| 2010/0136028 A1 | 6/2010 | Sparrow et al. |
| 2010/0150937 A1 | 6/2010 | Sparrow et al. |
| 2010/0166768 A1 | 7/2010 | Sleeman et al. |
| 2010/0233177 A1 | 9/2010 | Yowe et al. |
| 2010/0291099 A1 | 11/2010 | Glucksmann et al. |
| 2011/0027287 A1 | 2/2011 | Jackson et al. |
| 2011/0033465 A1 | 2/2011 | Hedrick |
| 2011/0065902 A1 | 3/2011 | Sleeman et al. |
| 2011/0105726 A1 | 5/2011 | Rosen |
| 2011/0117011 A1 | 5/2011 | Jackson et al. |
| 2011/0142849 A1 | 6/2011 | Rue |
| 2011/0229489 A1 | 9/2011 | Pons et al. |
| 2011/0230392 A1 | 9/2011 | Chiang et al. |
| 2011/0256148 A1 | 10/2011 | Sleeman et al. |
| 2012/0014951 A1 | 1/2012 | Liang et al. |
| 2012/0015435 A1 | 1/2012 | Liang et al. |
| 2012/0020975 A1 | 1/2012 | Jackson et al. |
| 2012/0020976 A1 | 1/2012 | Jackson et al. |
| 2012/0027765 A1 | 2/2012 | Jackson et al. |
| 2012/0076799 A1 | 3/2012 | Sparrow et al. |
| 2012/0077964 A1 | 3/2012 | Sparrow et al. |
| 2012/0082679 A1 | 4/2012 | Sparrow et al. |
| 2012/0082680 A1 | 4/2012 | Sitlani et al. |
| 2012/0195910 A1 | 8/2012 | Wu et al. |
| 2012/0208208 A1 | 8/2012 | Ni et al. |
| 2012/0208209 A1 | 8/2012 | Ichetovkin et al. |
| 2012/0213794 A1 | 8/2012 | Luo et al. |
| 2012/0213797 A1 | 8/2012 | Jackson et al. |
| 2012/0219558 A1 | 8/2012 | Ni et al. |
| 2012/0231005 A1 | 9/2012 | Luo et al. |
| 2012/0251544 A1 | 10/2012 | Jackson et al. |
| 2012/0301461 A1 | 11/2012 | Condra et al. |
| 2012/0321879 A1 | 12/2012 | Teutsch et al. |
| 2013/0052201 A1 | 2/2013 | Jackson et al. |
| 2013/0058944 A1 | 3/2013 | Jackson et al. |
| 2013/0064825 A1 | 3/2013 | Chan et al. |
| 2013/0064834 A1 | 3/2013 | Sleeman et al. |
| 2013/0071379 A1 | 3/2013 | Condra et al. |
| 2013/0071405 A1 | 3/2013 | Davies et al. |
| 2013/0072665 A1 | 3/2013 | Jackson et al. |
| 2013/0079501 A1 | 3/2013 | Jackson et al. |
| 2013/0079502 A1 | 3/2013 | Jackson et al. |
| 2013/0085265 A1 | 4/2013 | Jackson et al. |
| 2013/0085266 A1 | 4/2013 | Sleeman |
| 2013/0115223 A1 | 5/2013 | Sparrow et al. |
| 2013/0189278 A1 | 7/2013 | Sitlani |
| 2013/0245235 A1 | 9/2013 | Jackson et al. |
| 2013/0273069 A1 | 10/2013 | Liang et al. |

FOREIGN PATENT DOCUMENTS

| | | |
|---|---|---|
| EP | 1 618 212 | 11/2007 |
| EP | 2481758 | 1/2012 |
| EP | 2650016 | 10/2013 |
| JP | 2005/130764 | 5/2005 |
| WO | 93/12227 | 6/1993 |
| WO | 98/24893 | 6/1998 |
| WO | 00/76310 | 12/2000 |
| WO | 01/31007 | 5/2001 |
| WO | 2001/057081 | 8/2001 |
| WO | 01/98468 | 12/2001 |
| WO | 02/14358 | 2/2002 |
| WO | 02/46383 | 6/2002 |
| WO | 02/090526 | 11/2002 |
| WO | 02/102993 | 12/2002 |
| WO | 02/102994 | 12/2002 |
| WO | 2004/018649 | 3/2004 |
| WO | 2004/097047 | 11/2004 |
| WO | 2006/091899 | 8/2006 |
| WO | 2007/128121 | 11/2007 |
| WO | 2008/057457 | 5/2008 |
| WO | 2008/057458 | 5/2008 |
| WO | 2008/057459 | 5/2008 |
| WO | 2008/063382 | 5/2008 |
| WO | 2008/086395 | 7/2008 |
| WO | 2008/109871 A2 | 9/2008 |
| WO | 2008/109871 A3 | 9/2008 |
| WO | 2008/125623 | 10/2008 |
| WO | 2008/133647 | 11/2008 |
| WO | 2009/026558 | 2/2009 |
| WO | 2009/055783 | 4/2009 |
| WO | 2008/109871 A8 | 7/2009 |
| WO | 2009/100297 | 8/2009 |
| WO | 2009/100318 | 8/2009 |
| WO | 2009/131740 | 10/2009 |
| WO | 2010/029513 | 3/2010 |
| WO | 2010/077854 | 8/2010 |
| WO | 2011/037791 | 3/2011 |
| WO | 2011/053665 | 5/2011 |
| WO | 2011/053743 | 5/2011 |
| WO | 2011/053759 | 5/2011 |
| WO | 2011/053783 | 5/2011 |
| WO | 2011/072263 | 6/2011 |
| WO | 2011/111007 | 9/2011 |
| WO | 2012/054438 | 4/2012 |
| WO | 2012/088313 | 6/2012 |
| WO | 2012/101251 | 8/2012 |
| WO | 2012/101252 | 8/2012 |
| WO | 2012/101253 | 8/2012 |
| WO | 2012/109530 | 8/2012 |
| WO | 2012/154999 | 11/2012 |
| WO | 2012/168491 | 12/2012 |
| WO | 2012/170607 | 12/2012 |
| WO | 2012/177741 | 12/2012 |
| WO | 2013/008185 | 1/2013 |
| WO | 2013/016648 | 1/2013 |
| WO | 2013/039958 | 3/2013 |
| WO | 2013/039969 | 3/2013 |
| WO | 2013/041844 | 3/2013 |
| WO | 2013/148284 | 10/2013 |
| WO | 2013/170367 | 11/2013 |
| WO | 2013/172933 | 11/2013 |
| WO | 2014/194111 | 12/2014 |

OTHER PUBLICATIONS

Abifadel et al. "Mutations in PCSK9 cause autosomal dominant hypercholesterolemia" Nat. Genet. 34, 154-156 (2003).

Alborn et al., Serum proprotein convertase subtilisin kexin type 9 is correlated directly with serum LDL cholesterol:, Clin Chem, 53(10):1814-1819, (2007).

Allard et al., "Novel mutations of the PCSK9 gene cause variable phenotype of autosomal dominant hypercholesterolemia," Human mutation, 26(5), pp. 497, Nov. 2005.

Allard et al., "PC9, a new actor in autosomal dominant hypercholesterolemia," Current Genomics, 6(7), pp. 535-543, Nov. 2005.

Allard et al., Genetic heterogeneity of autosomal dominant hypercholesterolemia: PCSK9, a third genet involved in the disease:, Current Topics in Genetics, 1, pp. 103-112, 2005.

Anderson et al. Activation of the furin endoprotease is a multiple-step process: requirements for acidification and internal propeptide cleavage. EMBO J. 16, 1508-1518., 1997.

Attie et al., "Dual regulation of the LDL receptor—some clarity and new questions", Cell Metab., 1(5):290-292, (2005).

Attie et al., "The mystery of PCSK9", Ateriosler Thromb Vasc Biol., 24(8):1337-1339, (2004).

Austin et al., "Genetic causes of monogenic heterozygous familial hypercholesterolemia: a HuGE prevalence review", American Journal of Epidemiology, 160 (5) pp. 407-420, 2004.

Barrios et al., "Length of the Antibody Heavy Chain Complementarity Determining Region 3 as a Specificity-Determining Factor," J. Mol. Recognit., 2004, pp. 332-338, vol. 17.

Basak, A., "Inhibitors of Proprotien Convertases", J Mol Med 83: pp. 844-855, 2005.

Bedi et al., "Inhibition of squalene synthase upregulates PCSK9 expression in rat liver", Arch Biochem Biophys., 470(2):116-119, (2008).

(56) References Cited

OTHER PUBLICATIONS

Benjannet et al. (2006) "The Proprotein Convertase (PC) PCSK9 is Inactivated by Furin and/or PC5/6A," J. Biol. Chem. 281(41):30561-30572.
Benjannet et al. "NARC-1/PCSK9 and its natural mutants: zymogen cleavage and effects on the low density lipoprotein (LDL) receptor and LDL cholesterol." J Biol Chem, 2004, 279 (47): 48865-48875.
Berge et al. Missense mutations in the PCSK9 gene are associated with hypocholesterolemia and possibly increased response to statin therapy. Arterioscler. Thromb. Vasc. Biol. (2006) 26, 1094-1100.
Bingham et al. Proapoptotic Effects of NARC 1 (= PCSK9), the Gene Encoding a Novel Serine Proteinase. Cytometry Part A, 2006, 69A: 1123-1131.
Bottomley et al. Structural and biochemical characterization of the wild type PCSK9/EGF-AB complex and natural FH mutants. J Biol Chem Nov. 2008.
Brown, M.S. & Goldstein, J.L. Lowering LDL—not only how low, but how long? Science 311, 1721-1723 (2006).
Brunger et al., Crystallography & NMR System: A new software suite for macromolecular structure determination, Acta Crystallogr D Biol Crystallogr 54, 905-21 (1998).
Burnett et al. "New therapies for familial hypercholesterolemia" Expert Opin. Ther. Patents 16(3): 349-361, 2006.
Cameron et al. "Effect of mutations in the PCSK9 gene on the cell surface LDL receptors." Hum. Mol. Genet. 15, 1551-1558 (2006).
Cameron et al., "Berberine decreases PCSK9 expression in HepG2 cells", Atherosclerosis, 201(2):266-273, (2008).
Cameron et al., "Characterization of novel mutations in the catalytic domain of the PCSK9 gene", J Intern Med., 263 (4):420-431, (2008).
Cameron et al., "Investigations on the evolutionary conservation of PCSK9 reveal a functionally important protrusion," The FEBS Journal, pp. 1-13, 2008.
Campbell, Chapter 1, Monoclonal Antibody Technology, 1984 pp. 1-32, Elsevier Science Publishers B.V., The Netherlands.
Careskey et al., "Atorvastatin increases human serum levels of proprotein convertase subtilisin/kexin type 9", J Lipid Res., 49(2):394-398, (2008).
Casset et al. "A Peptide Mimetic of an Anti-CD4 Monoclonal Antibody by Rational Design," Biochemical and Biophysical Research Communications, 2003, vol. 307, pp. 198 205.
Cayman Chemical Company: "Material Safety Data Sheet PCSK9 (human) Polyclonal Antibody" Jul. 26, 2007, pp. 1-3.
Cayman Chemical Company: "Material Safety Data Sheet PCSK9 (murine) Polyclonal Antibody" Sep. 5, 2007, pp. 1-4.
Cayman Chemical Company: "Product information PCSK9 (murine) Polyclonal Antibody" Sep. 5, 2007, pp. 1-4.
Cayman Chemical Company: "Product information PCSK9 Polyclonal Antibody Catalog No. 10007185" Dec. 10, 2007, pp. 1-2.
Chamov and Ashkanazi, TIBTECH 14: 52-60, 1996 (entitled "Antibody Engineering at the Millennium").
Chan et al. (2009) "A Proprotein Convertase Subtilisin/Kexin Type 9 Neutralizing Antibody Reduced Serum Cholesterol in Mice and . . . ," Proc Natl Acad Sci USA 106(24):9820-9825.
Chen Bei et al. "Influence of histidine on the stability and physical properties of a fully human antibody in aqueous and solid forms" Pharmaceutical Research, Kluwer Academic Publishers, New York, NY vol. 20, No. 12, Dec. 1, 2003, pp. 1952-1960.
Chen et al., "Selection and Analysis of an Optimized Anti-VEGF Antibody: Crystal Structure of an Affinity Matured Fab in Complex with Antigen," J. Mol. Biol., 1999, vol. 293, pp. 865 881.
Chen et al., "A common PCSK9 haplotype, encompassing the E670G coding single nucleotide polymorphism, is a novel genetic marker for plasma low-density lipoprotein cholesterol levels and severity of coronary atherosclerosis", J Am Coll Cardiol. 45(10):1611-1619, (2005).
Cohen et al. Sequence variations in PCSK9, low LDL, and protection against coronary heart disease. N. Engl. J. Med. 354, 1264-1272 (2006).
Cohen et al., "Low LDL cholesterol in individuals of African descent resulting from frequent nonsense mutations in PCSK9", Nat Genet. 37(2):161-165, (2005), with Cohen et al., "Erratum: Low LDL cholesterol in African Americans resulting from frequent nonsense mutations in PCSK9," Nature Genetics, 37(3), pp. 328, 2005.
Colman (Research in Immunology, 1994. vol. 145, pp. 33-36).
Costet et al. Hepatic PCSK9 Expression Is Regulated by Nutritional Status via Insulin and Sterol Regulatory Element-binding Protein 1c. Journal of Biological Chemistry, Mar. 2006. 281(10): 6211-6218.
Costet et al., "PCSK9 and LDL cholesterol: unraveling the target to design the bullet", Trends Biochem Sci., 33(9):426-434, (2008).
Costet et al., "Proprotein Convertase Subtilisin Kexin type 9 is repressed by the peroxisome proliferator activated receptor alpha ligand fenofibric acid." Abstracts from Scientific Sessions 2006, 11-187. Basic Science.
Cunningham et al., "Structural and biophysical studies of PCSK9 and its mutants linked to familiar hypercholesterolemia," Nature Structural & Molecular Biology, vol. 14, No. 5, pp. 413-419 (May 2007).
Damgaard et al., "No genetic linkage or molecular evidence for involvement of the PCSK9, ARH or CYP7A1 genes in the Familial Hypercholesterolemia phenotype in a sample of Danish families without pathogenic mutations in the LDL receptor and apoB genes", Atherosclerosis 177 (2), pp. 415-422, 2004.
Davignon et al. "Erratum to NARC-1: A potential new target for drug therapy of hypercholesterolemia", Atherosclerosis, 176, pp. 429, 2004.
De Pascalis et al., "Grafting of 'Abbreviated' Complementarity Determining Regions Containing Specificity Determining Residues Essential for Ligand Contact to Engineer a Less Immunogenic Humanized Monoclonal Antibody," J. Immunol, 2002, vol. 169, pp. 3076-3084.
DeDoussis et al., "LDL-receptor mutations in Europe", Human Mutation, 24(6), pp. 443-459, 2004.
Ding et al., "Molecular population genetics of PCSK9: a signature of recent positive selection", Pharmacogenet Genomics. 18(3):169-179, (2008).
Dubuc et al. Statins upregulate PCSK9, the gene encoding the proprotein convertase neural apoptosis-regulated convertase-1 implicated in familial hypercholesterolemia. Arterioscler. Thromb. Vasc. Biol. 24, 1454-1459 (2004).
Duff et al. Antibody-mediated disruption of the interaction between PCSK9 and the low-density lipoprotein receptor. Biochemical Journal. Published online Feb. 5, 2009 as Manuscript BJ20082407.
EB 06682 Goat Anti-PCSK9 Antibody, Everest Biotech Online Catalogue, © 2007, auto-generated Sep. 7, 2007.
Ellis et al., "Engineered Anti-CD38 Monoclonal Antibodies for Immunotherapy of Multiple Myeloma." The Journal of Immunology 155 (1995): 925-937.
Evans et al., "The E670G SNP in the PCSK9 gene is associated with polygenic hypercholesterolemia in men but not in women", BMC Med Genet., 7:66, (2006).
Fan et al. "Self-Association of Human PCSK9 Correlates with Its LDLR-Degrading Activity", Biochemistry, 2008, 47: 1631-1639.
Fisher et al., "Effects of pH and low density lipoprotein (LDL) on PCSK9-dependent LDL receptor regulation", J Biol Chem, 282(28):20502-20512, (2007).
Folsom et al., "Variation in PCSK9, low LDL cholesterol, and risk of peripheral arterial disease", Atherosclerosis, 202 (1):211-215, (2009).
Fouchier et al., "PCSK9 mutations found in patients diagnosed with autosomal dominant hypercholesterolemia in the Netherlands", Circulation, 110 (17 Suppl. S) Oct. 26, 2004.
Fouchier et al., "Update of the molecular basis of familial hypercholesterolemia in The Netherlands," Human Mutation, 26(6), pp. 550-556, Dec. 2005.
Frank-Kamenetsky et al., "Therapeutic RNAi targeting PCSK9 acutely lowers plasma cholesterol in rodents and LDL cholesterol in nonhuman primates", Proc Natl Acad Sci., 105(33):11915-11920, (2008).
Fu et al. (2000). Folding pathway mediated by an intramolecular chaperone. The inhibitory and chaperone functions of the subtilisin propeptide are not obligatorily linked. J. Biol. Chem. 275, 16871-16878.
GenomeNet Database: UniProt, Entry: A0E922, Parte, Aury et al., 2006.

(56) References Cited

OTHER PUBLICATIONS

Goldstein et al. "Familial hypercholesterolemia" in The Metabolic & Molecular Bases of Inherited Disease (eds. Scriver, C.S. et al.) 2863-2913 (McGraw-Hill, New York, 2001).

Goldstein, J.L. & Brown, M.S. The cholesterol quartet. Science 292, 1310-1312 (2001).

Graadt Van Roggen et al., "FH Afrikaner-3 LDL receptor mutation results in defective LDL receptors and causes a mild form of familial hypercholesterolemia," Arteriosclerosis, Thrombosis, and Vascular Biology, 15(6), pp. 765-772, Jun. 1995.

Graadt Van Roggen et al., "Low density lipoprotein receptor founder mutations in Afrikaner familial hypercholesterolaemic patients: A comparison of two geographical areas," Human Genetics, 88(2), pp. 204-208, 1991.

Graham et al. Antisense inhibition of proprotein convertase subtilisin/kexin type 9 reduces serum LDL in hyperlipidemic mice. J Lipid Research 2007, 48: 763-767.

Graham et al., "Genetic screening protocol for familial hypercholesterolemia which includes splicing defects gives an improved mutation detection rate," Atherosclerosis, 182(2), pp. 331-340, Oct. 2005.

Grefhorst et al., "Plasma PCSK9 preferentially reduces liver LDL receptors in mice", J Lipid Res., 49 (6):1303-1311, (2008).

Grozdanov et al. "Expression and localization of PCSK9 in rat hepatic cells" Biochemistry and Cell Biology, Feb. 2006, 84(1): 80-92.

Grozdanov et al. "Expression of Pcsk9 in rat hepatic cells", FASEB Journal, 19(4, Suppl. S, Part 1, Mar. 4, 2005.

Hallman et al., "Relation of PCSK9 mutations to serum low-density lipoprotein cholesterol in childhood and adulthood (from the Bogalusa Heart Study)", Am J Cardiol., 100(1):69-72, (2007).

Hampton et al., "The self-inhibited structure of full-length PCSK9 at 1.9 A reveals structural homology with resistin within the C-terminal domain," Proc Nat Acad Sci USA, Sep. 2007, 104(37): 14604-14609.

Henrich et al. (2003). The crystal structure of the proprotein processing proteinase furin explains its stringent specificity. Nat. Struct. Biol. 10, 520-526.

Henrich et al. (2005). "Proprotein convertase models based on the crystal structures of furin and kexin:explanation of their specificity", J Mol Biol. 345(2):211-27 (2005).

Holla et al., "Degradation of the LDL receptors by PCSK9 is not mediated by a secreted protein acted upon by PCSK9 extracelluarly", BMC Cell Biol., 8:9, (2007).

Holla et al., "Low-density lipoprotein receptor activity in Epstein-Barr virus-transformed lymphocytes from heterozygotes for the D374Y mutation in the PCSK9 gene", Scand J Clin Lab, 66(4):317-328, (2006).

Hooper et al., "The C679X mutation in PCSK9 is present and lowers blood cholesterol in a Southern African population", Atherosclerosis, 193(2):445-448, (2007).

Horton et al., "Molecular biology of PCSK9: its role in LDL metabolism," Trends in Biochemical Sciences, 2006, vol. 32, No. 2, pp. 71-77.

Houghten et al., "Relative Importance of Position and Individual Amino Acid Residues in Peptide Antigen-Antibody Interactions: Implications in the Mechanism of Antigenic Drift and Antigenic Shift," New Approaches to Immunization, Vaccines 86, Cold Spring Harbor Laboratory, p. 21-25, 1986.

Human/Mouse Proprotein Convertase 9/PCSK9 Antibody, Monoclonal Rat IgG, Clone # 407119, Catalog No. MAB3888. R & D Systems: Tools for Cell Biology ResearchTM Rev. Oct. 12, 2010 p. 1 of 1. Available for sale since Jun. 2007.

Human/Mouse Proprotein Convertase 9/PCSK9 Antibody, Monoclonal Rat IgG, Clone # 407119, Catalog No. MAB38881. R & D Systems: Tools for Cell Biology ResearchTM Rev. Oct. 12, 2010 p. 1 of 1. Available for sale since Apr. 2008.

Human/Mouse Proprotein Convertase 9/PCSK9 Antibody, Monoclonal Rat IgG, Clone # 407119, Catalog No. MAB38882. R & D Systems: Tools for Cell Biology ResearchTM Rev. Oct. 12, 2010 p. 1 of 1. Available for sale since Feb. 2009.

Human Proprotein Convertase 9/PCSK9 Antibody, Antigen Affinity-purified Polyclonal Sheep IgG, Catalog No. AF3888. R & D Systems: Tools for Cell Biology ResearchTM Rev: Oct. 21, 2010 p. 1 of 1.

Ikemura et al., (1987). Requirement of pro-sequence for the production of active subtilisin E in *Escherichia coli*. J. Biol. Chem. 262, 7859-7864.

Jirholt et al., "How does mutant proprotein convertase neural apoptosis-regulated convertase 1 induce autosomal dominant hypercholersterolemia", Arteriosclerosis, Thrombosis and Vascular Biology, 24 (8) pp. 1334-1336, 2004.

Kala et al., "Phage Displayed Antibodies to Heat Stable Alkaline Phosphatase: Framework Region as a Determinant of Specificity," J. Biochem., 2002, pp. 535-541, vol. 132.

Kastelein et al., "What promise does PCSK9 hold?", J Am Coll Cardiol., 45(10):1620-1621, (2005).

Kathiresan et al., "A PCSK9 missense variant associated with a reduced risk of early-onset myocardial infarction", N Engl J Med., 358(21):2299-2300, (2008).

Kim et al. "Long-distance PCR-based screening for large rearrangements of the LDL receptor gene in Korean patients with familial hypercholesterolemia," Clinical Chemistry, 45(9), p. 1424-1430, 1999.

Knappik et al., "Fully Synthetic Human Combinatorial Antibody Libraries (HuCAL) Based on Modular Consensus Frameworks and CDRs Randomized with Trinucleotides." J Mol. Biol.296 (2000): 57-86.

Kotowski et al, A spectrum of PCSK9 alleles contributes to plasma levels of low-density lipoprotein cholesterol., Am. J. Hum. Genet. 2006;78:410-422.

Kotowski et al., "Multiple sequence variations in PCSK9 contribute to decreased plasma levels of LDL cholesterol," Circulation, 112 (17, Suppl. S), Oct. 25 2005. Abstract No. 1766.

Kotze et al., "Familial hypercholesterolemia: Potential diagnostic value of mutation screening in a pediatric population of South Africa," Clinical Genetics, 54(1), pp. 74-78, Jul. 1998.

Kourimate et al', "Dual mechanisms for the fibrate-mediated repression of proprotein convertase subtilisin/kexin type 9", J Biol Chem., 283(15):9666-9673, (2008).

Kwon et al. "Molecular basis for LDL receptor recognition by PSK9". PNAS Feb. 12, 2008, 105(6):1820-1825.

Lagace et al. (2006) "Secreted PCSK9 Decreases the Number of LDL Receptors in Hepatocytes and in Livers of Parabiotic Mice," J. Clin. Invest. 116(11):2995-3005.

Lalanne et al., "Wild-type PCSK9 inhibits LDL clearance but does not affect apoB-containing lipoprotein production in mouse and cultured cells", J Lipid Res., 46(6):1312-1319, (2005).

Lambert et al. PCSK9: a promising therapeutic target for dyslipidemias? Trends Endocrinol. Metab. 17, 79-81 (2006).

Lambert et al., "Fasting induces hyperlipidemia in mice overexpressing proprotein convertase subtilisin kexin type 9: lack of modulation of very-low density lipoprotein hepatic output by the low-density lipoprotein receptor", Endocrinology, 147(10):4985-4995, (2006).

Lambert et al., "Molecular basis of PCSK9 function", Atherosclerosis, 203(1):1-7, (2009).

Lambert et al., "Plasma PCSK9 concentrations correlate with LDL and total cholesterol in diabetic patients and are decreased by fenofibrate treatment", Clin Chem., 54(6):1038-1045, (2008).

Lambert et al., "Unravelling the functional significance of PCSK9", Curr Opin Lipidol., 18(3):304-309, (2007).

Lamminmaki et al., "Crystal Structure of a Recombinant Anti-estradiol Fab Fragment in Complex with 17β-Estradiol," The Journal of Biological Chemistry, vol. 276 (39), Sep. 28, 2001, pp. 36687 36694.

Langhi et al., "Activation of the farnesoid X receptor represses PCSK9 expression in human hepatocytes", FEBS Lett., 582(6):949-955, (2008).

Lederman et al., Molecular Immunology 28: 1171-1181, 1991.

Leren et al., "Mutations in the PCSK9 gene in Norwegian subjects with autosomal dominant hypercholesterolemia", Clin Genet., 65(5):419-422, (2004).

Li et al., "Secreted PCSK9 promotes LDL receptor degradation independently of proteolytic activity," Biochem J. 406, 203-207 (2007).

Li et al., PNAS 77: 3211-3214, 1980.

(56) References Cited

OTHER PUBLICATIONS

Lopez et al., "Inhibition of PCSK9 as a novel strategy for the treatment of hypercholesterolemia", Drug News Perspect., 21(6):323-330, (2008).
Lopez et al., "PCSK9: an enigmatic process", Biochim Biophys Acta., 1781(4):184-191, (2008).
Ma et al., "Functional Characterization of Novel Genes Regulated in a Cell Culture Model of Neuronal Apoptosis," Neuroscience 2002 Abstract, Nov. 5, 2002, p. 1.
MacCallum, et al. (Journal of Molecular Biology, 1996. vol. 262, pp. 732-745).
Marais et al., "The diagnosis and management of familial hypercholesterolaemia," European Review for Medical and Pharmacological Sciences, 9(3), pp. 141-149, May 2005.
Maxwell et al., "Overexpression of Pcsk9 leads to the formation of an LDLR-Pcsk9 complex and acceleration of LDLR degredation", Circulation, 110 (17 Suppl. S) Oct. 26, 2004. Abstract No. 1171.
Maxwell et al. "Adenoviral-mediated expression of PCSK9 in mice results in a low-desnity lipoprotein receptor knockout phenotype", Proc Natl Acad Sci USA, May 2004, 101(18): 7100-7105.
Maxwell et al. "Novel putative SREBP and LXR target genes identified by microarray analysis in liver of cholesterol-fed mice" Journal of Lipid Research, vol. 14, 2109-2119, 2003.
Maxwell et al. "Overexpression of PCSK9 accelerates the degradation of the LDLR in a post-endoplasmic reticulum compartment" Proc. Natl. Acad. Sci. USA (2005) 102, 2069-2074.
Maxwell, K.N. & Breslow, J.L. Proprotein convertase subtilisin kexin 9: the third locus implicated in autosomal dominant hypercholesterolemia. Curr. Opin. Lipidol. 16, 167-172 (2005).
Mayne et al., "Plasma PCSK9 levels are significantly modified by statins and fibrates in humans", Lipids Health Dis., 7:22, (2008).
Mayne et al., "Plasma PCSK9 Levels Correlate with Cholesterol in Men but not in Women." Biochemical and Biophysical Research Communications (BBRC) 361 (2007): 451-456.
Mbikay et al., "Of PCSK9, cholesterol homeostasis and parasitic infections: possible survival benefits of loss-of-function PCSK9 genetic polymorphisms", Med Hypotheses, 69(5):1010-1017, (2007).
McNutt, M.C. et al. Antagonism of secreted PCSK9 increases low density lipoprotein receptor expression in HepG2 cells—2009—Journal of Biological Chemistry, 284: 10561-10570.
McNutt et al., "Catalytic Activity Is Not Required for Secreted PCSK9 to Reduce Low Density Lipoprotein Receptors in HepG2 Cells," Journal of Biological Chemistry, vol. 282, No. 29, pp. 20799-20803 (Jul. 20, 2007).
Mendez et al., Nature Genetics, 15:146-156 (1997).
Naoumova et al., "Severe hypercholesterolemia in four British families with the D374Y mutation in the PCSK9 gene: Long-term follow-up and treatment response," Arteriosclerosis, Thrombosis, and Vascular Biology, 25(12), pp. 2654-2660, Dec. 2005.
Nassoury et al. "The Cellular Trafficking of the Secretory Proprotein Convertase PCSK9 and Its Dependence on the LDLR", Traffic, 2007, 8: 718-732.
Naureckiene et al. "Functional Characterization of Narc1, a Novel Proteinase Related to Proteinase K", Arch Biochem Biophys. Dec. 1, 2003;420(1):55-67.
Ngo et al., 1994, The Protein Folding Problem and Tertiary Structure Prediction, pp. 492-495.
Ni Yan G et al. A PCSK9 C-terminal Domain Binding Fab Inhibits PCSK9 Internalization and Restores LDL-uptake: Circulation, vol. 120 No. 18 Suppl 2, Nov. 2009, p. S477. Abstract No. 1318.
Otwinowski et al., Multiparametric scaling of diffraction intensities, Acta Crystallogr A 59, 228-34 (2003).
Ouguerram et al, Apolipoprotein B100 metabolism in autosomal-dominant hypercholesterolemia related to mutations in PCSK9, Arterioscler thromb Vasc Biol. 24: 1448-1453, 2004.
Padlan et al., "Structure of an Antibody-Antigen Complex: Crystal Structure of the HyHEL 10 Fab Lysozyme Complex," Proc. Natl. Acad. Sci., vol. 86, Aug. 1989, pp. 5938 5942.

Pandit et al., "Functional analysis of sites within PCSK9 responsible for hypercholesterolemia", J Lipid Res., 49 (6):1333-1343, (2008).
Parhofer et al., "What we have learned about VLDL and LDL metabolism from human kinetics studies", Journal of Lipid Research, 47(8), pp. 1620-1630, 2006.
Park et al., (2004). Post-transcriptional regulation of low density lipoprotein receptor protein by proprotein convertase subtilisin/kexin type 9a in mouse liver. J. Biol. Chem. 279, 50630-50638.
Paul, Fundamental Immunology, 3rd Edition, 1993, pp. 292-295, under the heading "Fv Structure and Diversity in Three Dimensions".
Peterson et al., "PCSK9 function and physiology", J Lipid Res., 49(7):1595-1599, (2008).
Piatesi et al., Immunological Optimizatino of a Generic Hydrophobic Pocket for High Affinity Hapten Binding and Diels-Alder Activicy, ChemBio Chem, Apr. 2004, pp. 460-466, vol. 5(4).
Piper et al., "The Crystal Structure of PCSK9: A Regulator of Plasma LDL-Cholesterol," Structure, 15, 1-8, pp. 545-552 (May 2007).
Pisciotta et al., "Additive effect of mutations in LDLR and PCSK9 genes on the phenotype of familial hypercholesterolemia," Atherosclerosis 186(2), pp. 433-440, Jun. 2006.
Poirier et al., "Implication of the proprotein convertase NARC-1/PCSK9 in the development of the nervous system", J Neurochem, 98(3):838-850, (2006).
Poirier et al., "The proprotein convertase PCSK9 induces the degradation of low density lipoprotein receptor (LDLR) and its closest family members VLDLR and ApoER2", J Biol Chem., 283(4):2363-2372, (2008).
Polisecki et al., "Genetic variation a the PCSK9 locus moderately lowers low-density lipoprotein cholesterol levels, but does not significantly lower vascular disease risk in an elderly population", Atherosclerosis, 200(1): 95-101, (2008).
Qian et al*, "Secreted PCSK9 downregulates low density lipoprotein receptor through receptor-mediated endocytosis", J Lipid Res., 48(7):1488-1498, (2007).
Rader et al. "Monogenic hypercholesterolemia: New insights in pathogenesis and treatment", Journal of Clinical Investigation, 111 (12), pp. 1795-1803, 2003.
Rashid et al. (2005) "Decreased Plasma Cholesterol and Hypersensitivity to Statins in Mice Lacking PCSK9," Proc Natl Acad Sci USA 102(15):5374-5379.
Ratliff et al., "Transgenic Expression of CYP7A1 in LDL Receptor-Deficient Mice Blocks Diet-Induced Hypercholesterolemia," Journal of Lipid Research, 47, 2006, ;; 1513-1520.
Rawlings et al., (2006). MEROPS: the peptidase database. Nucleic Acids Res. 34, D270-D272.
RCSB Protein Data Bank: An Information Portal to Biological Macromolecular Structures. Search Results for keyword "pcsk9", search conducted Jan. 10, 2008. Website accessed at http://www.rcsb.org/pdb/home/home.do—Piper et al. "The Crystal Structure of Proprotein convertase subtilisin kexin type 9 (PCSK9)" (Released May 8, 2007)—Cunningham et al. "Crystal Structure of PCSK9" (Deposited Mar. 12, 2007, released Apr. 10, 2007)—Kwon, H.J. "PCSK9: EGF-A complex" (Deposited Dec. 19, 2007, released Feb. 12, 2008).
Rudenko et al., "Structure of the LDL Receptor Extracellular Domain at Endosomal pH," Science 298, 2353-8 (2002).
Rudikoff et al. "Single Amino Acid Substitution Altering Antigen Binding Specificity" Proc. Natl. Acad. Sci. 79: 1979-1983, 1982.
Sakai et al., (1998). Molecular identification of the sterol-regulated lumina! protease that cleaves SREBPs and controls lipid composition of animal cells. Mol. Cell 2, 505-514.
Saint-Jore et al. "Autosomal dominant type IIa hypercholesterolemia: Evaluation of the respective contributions of LDLR and APOB gene defects as well as a third major group of defects," European Journal of Human Genetics, 8(8), pp. 621-630, 2000.
"Sanofi and Regeneron Report Positive Preliminary Phase 2 Program Results for Anti-PCSK9 Antibody in Hypercholesterolemia," http://www.prnewswire.com/news-releases/sandi-and-regeneron-report-positive-preliminary-phase-2-program-results-for-anti-pcsk9-antibody-in-hypercholesterolemia-133590188.html, PR Newswire, Nov. 10, 2011, pp. 1-3.

(56) References Cited

OTHER PUBLICATIONS

Schmidt et al. A Novel Splicing Variant of Proprotein Convertase Subtilisin/Kexin Type 9, DNA Cell Biol. Apr. 2008; 27(4):183-189.
Schmidt et al., "Secreted proprotein convertase subtilisin/kexin type 9 reduces both hepatic and extrahepatic low-density lipoprotein receptors in vivo", Biochem Biophys Res Commun., 370(4):634-640, (2008).
Schmidt et al., "A 15-ketosterol is a liver X receptor ligand that suppresses sterol-responsive element binding prSEIDAH et al., "The proprotein convertases and their implication in sterol and/or lipid metabolism", Biological Chemistry, 387(7), 871-877 (2006)otein-2 activity," Journal of Lipid Research, 47(5), May 2006, 1037-1044.
Seidah et al., (1999). Mammalian subtilisin/kexin isozyme SKI-1: a widely expressed proprotein convertase with a unique cleavage specificity and cellular localization. Proc. Natl. Acad. Sci. USA 96, 1321-1326.
Seidah et al., "The secretory proprotein convertase neural apoptosis-regulated convertase 1 (NARC-1): Liver regeneration and neuronal differentiation" PNAS 100: 928-933, 2003.
Seidah, N.G. and Pratt, A., "The proprotein convertases are potential targets in the treatment of dyslipidemia," J. Mol. Med., 95:685-696, Mar. 10, 2007.
Seidah et al., "The proprotein convertases in health and disease", Molecular & Cellular Proteomics, 2(9), Sep. 2003.
Shan et al., "PCSK9 binds to multiple receptors and can be functionally inhibited by an EGF-A peptide," Biochem. Biophys. Res. Commun., pp. 1-5 (2008).
Shioji et al., "Genetic variants in PCSK9 affect the cholesterol level in Japanese", Journal of Human Genetics, 49 (2) pp. 109-114, 2004.
Stahl, Neil, "Regeneron: Investor Day Early Clinical Development #1 REGN727: anti-PCSK9" Jul. 15, 2010: pp. 1-21.
Sun X-M et al, Evidence for effect of mutant PCSK9 on apoliprotein B secretion as the cause of unusually severe dominant hypercholesterolemia, Human Molecular Genetics 14: 1161-1169, 2005.
Tangrea et al., (2002). Solution structure of the pro-hormone convertase 1 pro-domain from Mus musculus. J. Mol. Biol. 320, 801-812.
Timms et al', "A mutation in PCSK9 causing autosomal-dominant hypercholesterolemia in a Utah pedigree", Hum Genet., 114(4):349-353, (2004).
Topol E.J., "Cholesterol, racial variation and targeted medicines," Nature Medicine, 11(2), pp. 122-123, Feb. 2005.
Topol et al., "Genetic susceptibility to myocardial infarction and coronary artery disease", Human Molecular Genetics, 15 (Rev. Issue 2), R117-R123, 2006.
Wosornu et al., "Genetic deficiency of proprotein convertase Subtilisin/Kexin 9: identification of a compound heterozygote with no PCSK9," Circulation, 114 (18, Suppl. S). Oct. 31, 2006.
Vajdos et al., "Comprehensive Functional Maps of the Antigen Binding Site of an Anti ErbB2 Antibody Obtained with Shotgun Scanning Mutagenesis," J. Mol. Biol., 2002, vol. 320, pp. 415 428.
Van Regenmortel et al., "Mapping Epitope Structure and Activity: From One-Dimensional Prediction to Four-Dimensional Description of Antigenic Specificity." Methods: A Companion to Methods in Enzymology 9 (1996): 465-472.
Varret et al. "A Third Major Locus for Autosomal Dominant Hypercholesterolema Maps to 1p34.1-p32" Am. J. Hum. Genet, 64:1378-1387, 1999.
Varret et al., "ARH and HCHOLA3: Two different genes at 1p both implicated in familial hypercholesterolemia," American Journal of Human Genetics, 71(4 Supplement), Oct. 2002 abstract 1597.
Varret et al., "Familial autosomal dominant hypercholesterolemia: Highly skewed contribution of mutations in the LDLR, APOB, FH3 and FH4 genes," Circulation, 106 (19 Supplement) Nov. 5, 2002 abstract 1461.
Wells, 1990, Biochemistry 29:8509-8517 (entitled "Additivity of mutational effects in proteins").
Yue et al., "The c.43_44insCTG variation in PCSK9 is associated with low plasma LDL-cholesterol in a Caucasian population," Human Mutation, 27(5), pp. 460-466, May 2006.
Wu et al., "Humanization of a Murine Monoclonal Antibody by Simultaneous Optimization of Framework and CDR Residues," J. Mol. Biol., 1999, vol. 294, pp. 151 162.
Zaid et al., "Proprotein convertase subtilisin/kexin type 9 (PCSK9): hepatocyte-specific low-density lipoprotein receptor degradation and critical role in mouse liver regeneration", Hepatology, 48(2):646-654, (2008).
Zhang et al. "Binding of PCSK9 to EGF-A Repeat of LDL Receptor Decreases Receptor Recycling and Increases Degradation," Journal of Biological Chemistry Apr. 23, 2007.
Zhang et al. "Structural requirements for PCSK9-mediated degradation of the low-density lipoprotein receptor." PNAS, Sep. 2, 2008, 105 (35): 13045-13050.
Zhang et al., "Binding of Proprotein Convertase Subtilisin/Kexin Type 9 to Epidermal Growth Factor-like Repeat A of Low Density Lipoprotein Receptor Decreases Receptor Recycling and Increases Degradation," Journal of Biological Chemistry, vol. 282, No. 25, pp. 18602-18612, Jun. 22, 2007.
Zhao et al., (2006). Molecular characterization of loss-of-function mutations in PCSK9 and identification of a compound heterozygote. Am. J. Hum. Genet. 79, 514-523.
Zhao et al., "Functional characterization of sequence variations in PCSK9," Circulation, 112 (17, Suppl. S.), Oct. 25, 2005.
Hampton et al. "The Crystal Structure of PCSK9 at 1.9 Angstroms Resolution Reveals Structure Homology to Resistin within the C-Terminal Domain" (PNAS 2007, 104: 14604).
Abifadel et al, Human Mutation, vol. 30, No. 4, pp. 520-529, 2009.
Aung, et al, Lipids in Health and Disease, vol. 10, No. 5, pp. 1-15, 2001.
Slimani, et al, J Mol Neurosci, Mar. 6, 2014, [Epub ahead of print], DOI 10.1007/s12031-014-0238-2.
Yende et al., "Genetic polymorphisms that predict outcome and need for treatment in cardiovascular disease," Current Opinion in Critical Care 12(5), pp. 420-425, Oct. 2006.
Davignon et al., "Narc-1: A Potential New Target for Drug Therapy of Hypercholesterolemia," XIIIth International Symposium on Atherosclerosis, Sep. 28-Oct. 2, 2003, Kyoto, Japan, pp. 182-183.
Akers Michael J. et al., "Formulation Development of Protein Dosage Forms" Pharmaceutical Biotechnology, Kluwer, Dordrecht, NL, vol. 14, Jan. 1, 2002, pp. 47-127.
CCP4. The CCP4 suite: programs for protein crystallography. Acta Crystallogr D. Biol Crystallogr 50, 760-3 (1994).
Bansal et al., "Cord blood lipoproteins and prenatal influences," Current Opinion in Lipidology, 16(4), pp. 400-408, Aug. 2005.
Jeon, H. & Blacklow, S.C. Structure and physiologic function of the low-density lipoprotein receptor. Annu. Rev. Biochem. 74, 535-562 (2005).
Seidah et al., "The proprotein convertases and their implication in sterol and/or lipid metabolism", Biological Chemistry, 387(7), 871-877 (2006).
Shen, et al., "The molecular genetics of coronary artery disease and myocardial infarction", Acute Coronary Syndromes, 6 (4), pp. 129-141, 2004.
Shibata, et al, "No genetic association between PCSK9 polymorphisms and Alzheimer's disease and plasma cholesterol level in Japanese patients", Psychiatric Genetics, 2005, vol. 15, pp. 239.
Tall, "Protease variants, LDL, and coronary heart disease," New England Journal of Medicine, 354(12), pp. 1310-1312, Mar. 23, 2006.
Villeger, et al., "Familial hypercholesterolemia: 30 years after Brown and Goldstein", Recent Research Developments in Human Genetics, 1(pt.1), pp. 35-51, 2002.
Mayne et al, Lipids in Health and Disease, vol. 12, No. 70, pp. 1-11, 2013.
Hopkins et al, Circulation, vol. 128, No. 22, p. 17156, 2013. Abstract only.

* cited by examiner

Variants:   f, c, m, e, h, p, q          f, c, m, e, h          f, c, m, e, h

Variants:        f, c, p, aj                f, c, p

Non-Synonymous FW1 residue change to Valine due to rs56069819 SNP is underlined)

E V Q L <u>V</u> E S G G G L V Q P G G S L R
L S C A A S G F T F S S Y A M S W V R
Q A P G K G L E W V S A I S G S G G S
T Y Y A D S V K G R F T I S R D N S K
N T L Y L Q M N S L R A E D T A V Y Y
C A K

VH3-23*04

(rs56069819 SNP is underlined)

gag gtg cag ctg <u>g</u>tg gag tct ggg gga ggc ttg gta cag cct ggg
ggg tcc ctg aga ctc tcc tgt gca gcc tct gga ttc acc ttt agc agc tat
gcc atg agc tgg gtc cgc cag gct cca ggg aag ggg ctg gag tgg
gtc tca gct att agt ggt agt ggt ggt agc aca tac tac gca gac tcc
gtg aag ggc cgg ttc acc atc tcc aga gac aat tcc aag aac acg ctg
tat ctg caa atg aac agc ctg aga gcc gag gac acg gcc gta tat tac
tgt gcg aaa ga FW1 Encoded by VH3-23*04

PRECISION MEDICINE BY TARGETING HUMAN NAV1.9 VARIANTS FOR TREATMENT OF PAIN

CROSS-REFERENCE TO RELATED APPLICATIONS

This application is a continuation-in-part of U.S. application Ser. No. 14/331,730 filed Jul. 15, 2014, the entire content of which is incorporated by reference.

SEQUENCE LISTING

The instant application contains a Sequence Listing which has been submitted electronically in ASCII format and is hereby incorporated by reference in its entirety. Said ASCII copy, created on created on created on Mar. 23, 2015, is named 069496-082417_SL.txt and is 623,759 bytes in size.

TECHNICAL FIELD

The technology described herein relates to ligands, e.g., antibodies for the treatment of disease.

BACKGROUND

It is recognized that individual humans differ in their sequence and recently several individuals have had their genomes sequenced, for instance James Watson and Craig Venter. Comparison of the genome sequence of individuals has revealed differences in their sequences in both coding and non-coding parts of the genome. Some of these variations in humans are significant and contribute to phenotypic differences between individuals. In extreme cases these will result in genetic disease. The 1000 Genomes Project has the objective of cataloguing sequences in the human genome, involving sequencing the genomes of a very large sampling of individuals from diverse art-recognized human ethnic populations.

SUMMARY

Through the application of human genetic variation analysis and rationally-designed sequence selection the present invention provides for improved human patient diagnosis and therapy. Importantly, the invention enables tailored medicines that address individual human patient genotypes or phenotypes.

The inventor's analysis of large numbers of naturally-occurring genomic human TOI sequences reveals that there is significant variation across diverse human populations and provides for the ability for correlation between individual human patients and tailored medical and diagnostic approaches addressing the target. The technical applications of these findings, as per the present invention, thus contribute to better treatment, prophylaxis and diagnosis in humans and provides for patient benefit by enabling personalized medicines and therapies. This provides advantages of better prescribing, less wastage of medications and improved chances of drug efficacy and better diagnosis in patients.

Furthermore, the inventor surprisingly realised that some rarer natural forms, although present in humans at much lower frequencies than the common form, nevertheless are represented in multiple and ethnically-diverse human populations and usually with many human examples per represented ethnic population. Thus, the inventor realised that targeting such rarer forms would provide for effective treatment, prophylaxis or diagnosis across many human ethnic populations, thereby extending the utility of the present invention and better serving patients in those populations.

With this, the inventor realised that there is significant industrial and medical application for the invention in terms of guiding the choice of an anti-TOI ligand for administration to human patients for therapy and/or prophylaxis of TOI-mediated or associated diseases and conditions. In this way, the patient receives drugs and ligands that are tailored to their needs—as determined by the patient's genetic or phenotypic makeup. Hand-in-hand with this, the invention provides for the genotyping and/or phenotyping of patients in connection with such treatment, thereby allowing a proper match of drug to patient. This increases the chances of medical efficacy, reduces the likelihood of inferior treatment using drugs or ligands that are not matched to the patient (eg, poor efficacy and/or side-effects) and avoids pharmaceutical mis-prescription and waste.

To this end, the invention provides:—

In a First Configuration

A method of treating or preventing a disease or condition in a human, wherein the disease or condition is mediated by a Target of Interest (TOI), wherein the TOI is present in humans as different polymorphic variants, the method comprising a. Administering to the human an anti-TOI ligand to target a TOI variant in the human and treat or prevent said disease or condition, wherein the TOI in said human is encoded by a nucleotide sequence having a cumulative human allele frequency of less than 50% and/or wherein the TOI in said human is encoded by a nucleotide sequence having a total human genotype frequency of less than 50%; wherein b. Before step (a) said human has been or is genotyped as positive for said nucleotide sequence or phenotyped as positive for said TOI variant.

In a Second Configuration

A method of treating or preventing a disease or condition in a human, wherein the disease or condition is mediated by a Target of Interest (TOI), wherein the TOI is present in humans as different polymorphic variants, the method comprising a. Administering to the human an anti-TOI ligand to target a TOI variant in the human and treat or prevent said disease or condition, wherein the TOI in said human is encoded by a nucleotide sequence having a cumulative human allele frequency of less than 50% and/or wherein the TOI in said human is encoded by a nucleotide sequence having a total human genotype frequency of less than 50%; wherein b. before step (a) the ligand has been or is determined as capable of binding to said TOI variant.

In a Third Configuration

A method of treating or preventing a disease or condition in a human, wherein the disease or condition is mediated by a Target of Interest (TOI), wherein the TOI is present in humans as different polymorphic variants, the method comprising a. Administering to the human an anti-TOI ligand to target a TOI variant in the human and treat or prevent said disease or condition, wherein the TOI in said human is a variant encoded by a nucleotide sequence having a cumulative human allele frequency of more than 50% and/or having a total human genotype frequency of more than 50%; wherein b. Before step (a) said human has been or is genotyped as negative for a variant nucleotide sequence having a cumulative human allele frequency of less than 50% and/or having a total human genotype frequency of less than 50%; or phenotyped as negative for a TOI variant encoded by a nucleotide sequence having a cumulative human allele frequency of less than 50% and/or having a total human genotype frequency of less than 50%.

In a Fourth Configuration

An anti-human TOI ligand for use in a method of treating and/or preventing a TOI-mediated disease or condition in a human, wherein the TOI is present in humans as different polymorphic variants and wherein the genome of said human comprises a TOI nucleotide sequence having a cumulative human allele frequency of less than 50% and/or a total human genotype frequency of less than 50%, the method comprising administering the ligand to the human.

In a Fifth Configuration

A ligand that binds a human TOI comprising an amino acid sequence encoded by a TOI nucleotide sequence having a cumulative human allele frequency of less than 50% and/or a total human genotype frequency of less than 50%, for use in a method comprising the step of using the ligand to target said TOI in a human to treat and/or prevent a disease or condition mediated by TOI, the method comprising administering the ligand to the human.

In a Sixth Configuration

A pharmaceutical composition or kit for treating or preventing a condition or disease mediated by a TOI.

In a Seventh Configuration

A method of producing an anti-human TOI antibody binding site, the method comprising obtaining a plurality of anti-TOI antibody binding sites, screening the antibody binding sites for binding to a TOI comprising an amino acid sequence encoded by a nucleotide sequence having a cumulative human allele frequency of less than 50% and/or a total human genotype frequency of less than 50%, or to a peptide thereof that comprises an amino acid variation from the corresponding sequence encoded by the TOI-encoding nucleotide sequence having the highest cumulative human allele frequency and/or the highest total human genotype frequency, and isolating an antibody binding site that binds in the screening step.

In a Eighth Configuration

A method of producing an anti-human TOI antibody, the method comprising immunising a non-human vertebrate (eg, a mouse or a rat) with a TOI comprising an amino acid sequence encoded by a nucleotide sequence having a cumulative human allele frequency of less than 50% and/or a total human genotype frequency of less than 50%, or to a peptide thereof that comprises an amino acid variation from the corresponding sequence encoded by the TOI-encoding nucleotide sequence having the highest cumulative human allele frequency and/or the highest total human genotype frequency, and isolating an antibody that binds a TOI comprising an amino acid sequence encoded by a TOI nucleotide sequence having a cumulative human allele frequency of less than 50% and/or a total human genotype frequency of less than 50%, and optionally producing a TOI-binding fragment or derivative of the isolated antibody.

In a Ninth Configuration

A kit for TOI genotyping a human, wherein the kit comprises a nucleic acid comprising a nucleotide sequence that specifically hybridises to a TOI nucleotide sequence selected having a cumulative human allele frequency of less than 50% and/or a total human genotype frequency of less than 50% or an RNA transcript thereof and/or the nucleic acid comprises a nucleotide sequence that comprises at least 10 contiguous nucleotides of a TOI nucleotide sequence having a cumulative human allele frequency of less than 50% and/or a total human genotype frequency of less than 50% or is an antisense sequence thereof.

In a Tenth Configuration

Use of an anti-TOI ligand that binds a human TOI comprising an amino acid sequence encoded by a TOI nucleotide sequence having a cumulative human allele frequency of less than 50% and/or a total human genotype frequency of less than 50%, in the manufacture of a medicament for treating and/or preventing a TOI-mediated disease or condition in a human whose genome comprises a TOI nucleotide sequence having a cumulative human allele frequency of less than 50% and/or having a total human genotype frequency of less than 50%.

In a Eleventh Configuration

Use of an anti-TOI ligand that binds a human TOI comprising an amino acid sequence encoded by a TOI nucleotide sequence having a cumulative human allele frequency of less than 50% and/or a total human genotype frequency of less than 50%, in the manufacture of a medicament for targeting said TOI in a human to treat and/or prevent a disease or condition mediated by TOI.

In a Twelfth Configuration

A method of targeting a TOI for treating and/or preventing a TOI-mediated disease or condition in a human, the method comprising administering an anti-TOI ligand to a human comprising a TOI nucleotide sequence selected having a cumulative human allele frequency of less than 50% and/or a total human genotype frequency of less than 50%, whereby a TOI encoded by said nucleotide sequence is targeted.

In a Thirteenth Configuration

A method of TOI genotyping a nucleic acid sample of a human, the method comprising identifying in the sample the presence of a TOI nucleotide sequence having a cumulative human allele frequency of less than 50% and/or having a total human genotype frequency of less than 50%.

In a Fourteenth Configuration

A method of TOI typing a protein sample of a human, the method comprising identifying in the sample the presence of a TOI amino acid sequence encoded by a TOI nucleotide sequence having a cumulative human allele frequency of less than 50% and/or having a total human genotype frequency of less than 50%.

In an example, the TOI is a human TOI selected from the group consisting of PCSK9, VEGF-A and IL6 receptor. In an example, the TOI is human IL4Ra, PDGF-B, PDGFR-B or Ang-2.

A Fifteenth Configuration provides a ligand, method, use, kit or composition of the invention, wherein (i) the ligand (eg, antibody or fragment) comprises
   (a) a variable domain that is encoded by a human V region nucleotide sequence, wherein the V nucleotide sequence is derived from recombination of human VH, D and JH gene segments or human VL and JL gene segments; or
   (b) a constant region domain encoded by a C region gene segment;
   Wherein a first gene segment of said gene segments of (a), or said C region gene segment of (b) comprises a first single nucleotide polymorphism (SNP) encoding a first amino acid polymorphism; and
(ii) the genome of said human comprises said first SNP or wherein said human expresses (a') an antibody variable domain comprising said first amino acid polymorphism or (b') an antibody constant domain comprising said first amino acid polymorphism.

A Sixteenth Configuration provides the ligand, method, use, kit or composition of the invention, wherein the ligand comprises or consists of an antibody or fragment that comprises a human antibody variable domain derived from the recombination of a human V gene segment and a human J gene segment (and optionally a human D gene segment when the variable domains are VH domains); and wherein the genome of the human comprises said human V gene segment and/or the human expresses antibodies comprising antibody variable domains derived from the recombination of said human V gene segment and a human J gene segment (and optionally a human D gene segment).

A Sixteenth Configuration provides the ligand, method, use, kit or composition of the invention, wherein the ligand (eg, comprising or consisting of an antibody or fragment or an Fc-fused human PCSK9 receptor) comprises a human heavy chain constant domain encoded by a first constant region nucleotide sequence; and wherein the genome of the human comprises a heavy chain constant region nucleotide sequence that is identical to said first constant region nucleotide sequence and/or the human expresses antibodies comprising said human constant domain.

A Seventeenth Configuration provides the ligand, method, use, kit or composition of the invention, wherein the ligand (eg, comprising or consisting of an antibody or fragment or an Fc-fused TOI receptor) comprises a human gamma-1 heavy chain constant region that comprises an Asp corresponding to position 204 of SEQ ID NO: 42 or a Leu corresponding to position 206 of SEQ ID NO: 42 and wherein the genome of the human comprises a gamma-1 heavy chain constant region nucleotide sequence that encodes such an Asp or Leu or the human expresses antibodies comprising human gamma-1 constant regions comprising such an Asp or Leu.

A Eighteenth Configuration provides the ligand, method, use, kit or composition of the invention, wherein the ligand (eg, comprising or consisting of an antibody or fragment or an Fc-fused TOI receptor) comprises a human gamma-2 heavy chain constant region that comprises an amino acid selected from the group consisting of a Pro corresponding to position 72 of SEQ ID NO: 44, an Asn corresponding to position 75 of SEQ ID NO: 44, a Phe corresponding to position 76 of SEQ ID NO: 44, a Val corresponding to position 161 of SEQ ID NO: 44 and an Ala corresponding to position 257 of SEQ ID NO: 44; and wherein the genome of the human comprises a gamma-2 heavy chain constant region nucleotide sequence that encodes such a selected amino acid or the human expresses antibodies comprising human gamma-2 constant regions comprising such a selected amino acid.

A Ninteenth Configuration provides the ligand, method, use, kit or composition of the invention, wherein the ligand (eg, comprising or consisting of an antibody or fragment or an Fc-fused TOI receptor) comprises a human kappa light chain constant region that comprises a Val corresponding to position 84 of SEQ ID NO: 50 or a Cys corresponding to position 87 of SEQ ID NO: 50; and wherein the genome of the human comprises a kappa light chain constant region nucleotide sequence that encodes such a Val or Cys or the human expresses antibodies comprising human kappa light chain constant regions comprising such a Val or Cys.

A Twentieth Configuration provides the ligand, method, use, kit or composition of the invention, wherein the ligand comprises or consists of an antibody or fragment, wherein the antibody or fragment comprises a VH domain that is derived from the recombination of a human VH gene segment, a human D gene segment and a human JH gene segment, wherein the VH gene segment is selected from the group consisting of (i) IGHV1-18*01 and the genome of the human comprises a human IGHV1-18*01 nucleotide sequence or the human expresses antibodies comprising variable domains derived from the recombination of human IGHV1-18*01; or (ii) IGVH1-46*01 and the genome of the human comprises a human IGHV1-46*01 nucleotide sequence or the human expresses antibodies comprising variable domains derived from the recombination of human IGHV1-46*01.

A Twenty-First Configuration provides the ligand, method, use, kit or composition of the invention, wherein the ligand comprises or consists of an antibody or fragment, wherein the antibody or fragment comprises a VL domain that is derived from the recombination of a human VL gene segment and a human JL gene segment, wherein the VL gene segment is selected from the group consisting of (i) IGKV4-1*01 and the genome of the human comprises a human IGKV4-1*01 nucleotide sequence or the human expresses antibodies comprising variable domains derived from the recombination of human IGKV4-1*01; (ii) IGLV2-14*01 and the genome of the human comprises a human IGLV2-14*01 nucleotide sequence or the human expresses antibodies comprising variable domains derived from the recombination of human IGLV2-14*01; or (iii) IGKV1-13*02 and the genome of the human comprises a human IGKV1-13*02 nucleotide sequence or the human expresses antibodies comprising variable domains derived from the recombination of human IGKV1-13*02.

A Twenty-Second Configuration provides a method of treating or reducing the risk of an IL4Ra-mediated disease or condition in a human in need thereof, the method comprising administering to said human a ligand (eg, an antibody or antibody fragment) that specifically binds a human IL4RA protein that comprises a mutation selected from the group consisting of I75V, E400A, C431R, S503P, Q576R and S752A in SEQ ID NO: 67. As explained further below, these amino acid variations are found in naturally-occurring IL-4Ra variants in humans found in many populations. Said human comprises a nucleotide sequence encoding said IL4RA protein comprising said mutation selected from the group consisting of I75V, E400A, C431R, S503P, Q576R and S752A in SEQ ID NO: 67.

A Twenty-Third Configuration provides a ligand (eg, an antibody or antibody fragment) for treating or reducing the risk of an IL4Ra-mediated disease or condition in a human in need thereof, the method comprising administering to said human said ligand, wherein the ligand specifically binds a human IL4RA protein that comprises a mutation selected from the group consisting of I75V, E400A, C431R, S503P, Q576R and S752A in SEQ ID NO: 67. Said human comprises a nucleotide sequence encoding said IL4RA protein comprising said mutation selected from the group consisting of I75V, E400A, C431R, S503P, Q576R and S752A in SEQ ID NO: 67.

A Twenty-Fourth Configuration provides a method of targeting IL4Ra in a human, the method comprising administering to said human a ligand (eg, an antibody or antibody fragment) that specifically binds a human IL4RA protein that comprises a mutation selected from the group consisting of I75V, E400A, C431R, S503P, Q576R and S752A in SEQ ID NO: 67. Said human comprises a nucleotide sequence encoding said IL4RA protein comprising said mutation selected from the group consisting of I75V, E400A, C431R, S503P, Q576R and S752A in SEQ ID NO: 67. In an example, the human is suffering from or at risk of an IL4Ra-mediated disease or condition. In an example, the method treats or reduces the risk of an IL4Ra-mediated disease or condition in the human.

A Twenty-Fifth Configuration provides a ligand (eg, an antibody or antibody fragment) for targeting IL4Ra in a human, the method comprising administering to said human said ligand, wherein the ligand specifically binds a human IL4RA protein that comprises a mutation selected from the group consisting of I75V, E400A, C431R, S503P, Q576R and S752A in SEQ ID NO: 67. Said human comprises a nucleotide sequence encoding said IL4RA protein comprising said mutation selected from the group consisting of I75V, E400A, C431R, S503P, Q576R and S752A in SEQ ID NO: 67. In an example, the human is suffering from or at risk of an IL4Ra-mediated disease or condition. In an example, the method treats or reduces the risk of an IL4Ra-mediated disease or condition in the human.

In an embodiment of any of the 21-25$^{th}$ configurations, (i) the antibody or fragment comprises a VH domain derived from the recombination of a human VH segment, a human D gene segment and a human JH segment, the human VH segment encoding the framework 1 of SEQ ID NO: 40 and wherein said human comprises a VH gene segment encoding the framework 1 of SEQ ID NO: 40, or the human expresses VH domains that comprise the framework 1 of SEQ ID NO: 40; and wherein (ii) said human comprises a nucleotide sequence encoding said IL4RA protein comprising said mutation selected from the group consisting of I75V, E400A, C431R, S503P, Q576R and S752A in SEQ ID NO: 67.

Additionally or alternatively, in an embodiment of any of the 21-25$^{th}$ configurations, (i) the antibody or fragment comprises a human gamma-4 heavy chain constant region that comprises a Leu at position 189 shown in SEQ ID NO: 73 or an Arg at position 289 shown in SEQ ID NO: 73 and wherein said human comprises an IGHG4*01 human heavy chain constant region gene segment, or the human expresses antibodies comprising human gamma-4 heavy chain constant regions comprising a Leu at position 189 shown in SEQ ID NO: 73 or an Arg at position 289 shown in SEQ ID NO: 73; and wherein (ii) said human comprises a nucleotide sequence encoding said IL4RA protein comprising said mutation selected from the group consisting of I75V, E400A, C431R, S503P, Q576R and S752A in SEQ ID NO: 67.

In a Twenty-sixth Configuration, described herein is a method of treating or reducing the risk of a Nav1.7-mediated disease or condition in a human in need thereof, the method comprising administering to said human a ligand (eg, an antibody or antibody fragment) that specifically binds a huma Nav1.7 protein that comprises an amino acid selected from the group consisting of 136I, 216S, 241T, 395K, 848T, 858H, 858F, 863P, 1449V, 996C, 1298F, 1298D, 1299F, 1461T, 1462V, 1464I, 1627K, 277X (wherein X is an amino acid other than R), 328X (wherein X is an amino acid other than Y), 395K, 459X (wherein X is an amino acid other than S), 693 X (wherein X is an amino acid other than E), 767X (wherein X is an amino acid other than I), 830X (wherein X is an amino acid other than R), 897X (wherein X is an amino acid other than W), 1200L, 1235L, 1488X (wherein X is an amino acid other than R), 1659X (wherein X is an amino acid other than K), 1689X (wherein X is an amino acid other than W), 422D, 490N, 943L, 1002L, 1161W and 1919G; wherein (i) the ligand comprises a human gamma-4 heavy chain constant region that comprises a Leu at position 189 shown in SEQ ID NO: 73 or an Arg at position 289 shown in SEQ ID NO: 73 and wherein said human comprises (i) an IGHG4*01 human heavy chain constant region gene segment, or the human expresses antibodies comprising human gamma-4 heavy chain constant regions comprising a Leu at position 189 shown in SEQ ID NO: 73 or an Arg at position 289 shown in SEQ ID NO: 73; and wherein (ii) said human comprises a nucleotide sequence encoding said Nav1.7 protein comprising said amino acid selected from the group consisting of 136I, 216S, 241T, 395K, 848T, 858H, 858F, 863P, 1449V, 996C, 1298F, 1298D, 1299F, 1461T, 1462V, 1464I, 1627K, 277X (wherein X is an amino acid other than R), 328X (wherein X is an amino acid other than Y), 395K, 459X (wherein X is an amino acid other than S), 693 X (wherein X is an amino acid other than E), 767X (wherein X is an amino acid other than I), 830X (wherein X is an amino acid other than R), 897X (wherein X is an amino acid other than W), 1200L, 1235L, 1488X (wherein X is an amino acid other than R), 1659X (wherein X is an amino acid other than K), 1689X (wherein X is an amino acid other than W), 422D, 490N, 943L, 1002L, 1161W and 1919G. The invention also provides a corresponding ligand, eg, antibody or antibody fragment, for use in such a method.

In some embodiments, said amino acid is selected from the group consisting of any one of 136I, 216S, 241T, 395K, 848T, 858H, 858F, 863P and 1449V; optionally wherein said disease or condition is a pain disease or condition. In some embodiments, said amino acid is selected from the group consisting of 996C, 1298F, 1298D, 1299F, 1461T, 1462V, 1464I and 1627K; optionally wherein said disease or condition is a pain disease or condition. In some embodiments, said amino acid is selected from the group consisting of 277X (wherein X is an amino acid other than R), 328X (wherein X is an amino acid other than Y), 395K, 459X (wherein X is an amino acid other than S), 693 X (wherein X is an amino acid other than E), 767X (wherein X is an amino acid other than I), 830X (wherein X is an amino acid other than R), 897X (wherein X is an amino acid other than W), 1200L, 1235L, 1488X (wherein X is an amino acid other than R), 1659X (wherein X is an amino acid other than K) and 1689X (wherein X is an amino acid other than W); optionally wherein said disease or condition is a pain disease or condition.

In some embodiments, the constant region gene segment comprised by said human is a germline gene segment. In some embodiments, the method further comprises, before said administering, selecting a human comprising said nucleotide sequence of (ii).

In some embodiments, the human has been determined to comprise the nucleotide sequence that encodes a Nav1.7 protein comprising said amino acid selected from the group consisting of 136I, 216S, 241T, 395K, 848T, 858H, 858F, 863P, 1449V, 996C, 1298F, 1298D, 1299F, 1461T, 1462V, 1464I, 1627K, 277X (wherein X is an amino acid other than R), 328X (wherein X is an amino acid other than Y), 395K, 459X (wherein X is an amino acid other than S), 693 X (wherein X is an amino acid other than E), 767X (wherein X is an amino acid other than I), 830X (wherein X is an amino acid other than R), 897X (wherein X is an amino acid other than W), 1200L, 1235L, 1488X (wherein X is an amino acid other than R), 1659X (wherein X is an amino acid other than K), 1689X (wherein X is an amino acid other than W), 422D, 490N, 943L, 1002L, 1161W and 1919G and/or a Nav1.7 protein comprising said amino acid selected from the group consisting of 136I, 216S, 241T, 395K, 848T, 858H, 858F, 863P, 1449V, 996C, 1298F, 1298D, 1299F, 1461T, 1462V, 1464I, 1627K, 277X (wherein X is an amino acid other than R), 328X (wherein X is an amino acid other than Y), 395K, 459X (wherein X is an amino acid other than S), 693 X (wherein X is an amino acid other than E), 767X (wherein X is an amino acid other than I), 830X (wherein X is an amino acid other than R), 897X (wherein X is an amino acid other than W), 1200L, 1235L, 1488X (wherein X is an amino acid other than R), 1659X (wherein X is an amino acid other than K), 1689X (wherein X is an amino acid other than W), 422D, 490N, 943L, 1002L, 1161W and 1919G.

In some embodiments, the method further comprises the step of determining that the human comprises (a) the nucleotide sequence that encodes a Nav1.7 protein comprising said amino acid selected from the group consisting of 136I, 216S, 241T, 395K, 848T, 858H, 858F, 863P, 1449V, 996C, 1298F, 1298D, 1299F, 1461T, 1462V, 1464I, 1627K, 277X (wherein X is an amino acid other than R), 328X (wherein X is an amino acid other than Y), 395K, 459X (wherein X is an amino acid other than S), 693 X (wherein X is an amino acid other than E), 767X (wherein X is an amino acid other than I), 830X (wherein X is an amino acid other than R), 897X (wherein X is an amino acid other than W), 1200L, 1235L, 1488X (wherein X is an amino acid other than R), 1659X (wherein X is an amino acid other than K), 1689X (wherein X is an amino acid other than W), 422D, 490N, 943L, 1002L, 1161W and 1919G and/or (b) a Nav1.7 protein comprising said amino acid selected from the group consisting of 136I, 216S, 241T, 395K, 848T, 858H, 858F, 863P, 1449V, 996C, 1298F, 1298D, 1299F, 1461T, 1462V, 1464I, 1627K, 277X (wherein X is an amino acid other than R), 328X (wherein X is an amino acid other than Y), 395K, 459X (wherein X is an amino acid other than S), 693 X (wherein X is an amino acid other than E), 767X (wherein X is an amino acid other than I), 830X (wherein X is an amino acid other than R), 897X (wherein X is an amino acid other than W), 1200L, 1235L, 1488X (wherein X is an amino acid other than R), 1659X (wherein X is an amino acid other than K), 1689X (wherein X is an amino acid other than W), 422D, 490N, 943L, 1002L, 1161W and 1919G, optionally, wherein the determining step is performed before administration of the antibody to the human. In some embodiments, the step of determining comprises assaying a biological sample from the human for a nucleotide sequence encoding a Nav1.7 protein comprising said amino acid selected from the group consisting of 136I, 216S, 241T, 395K, 848T, 858H, 858F, 863P, 1449V, 996C, 1298F, 1298D, 1299F, 1461T, 1462V, 1464I, 1627K, 277X (wherein X is an amino acid other than R), 328X (wherein X is an amino acid other than Y), 395K, 459X (wherein X is an amino acid other than S), 693 X (wherein X is an amino acid other than E), 767X (wherein X is an amino acid other than I), 830X (wherein X is an amino acid other than R), 897X (wherein X is an amino acid other than W), 1200L, 1235L, 1488X (wherein X is an amino acid other than R), 1659X (wherein X is an amino acid other than K), 1689X (wherein X is an amino acid other than W), 422D, 490N, 943L, 1002L, 1161W and 1919G. In some embodiments, the assaying comprises contacting the biological sample with at least one oligonucleotide probe comprising a sequence of at least 10 contiguous nucleotides of a nucleotide sequence encoding a Nav1.7 protein comprising said amino acid selected from the group consisting of 136I, 216S, 241T, 395K, 848T, 858H, 858F, 863P, 1449V, 996C, 1298F, 1298D, 1299F, 1461T, 1462V, 1464I, 1627K, 277X (wherein X is an amino acid other than R), 328X (wherein X is an amino acid other than Y), 395K, 459X (wherein X is an amino acid other than S), 693 X (wherein X is an amino acid other than E), 767X (wherein X is an amino acid other than I), 830X (wherein X is an amino acid other than R), 897X (wherein X is an amino acid other than W), 1200L, 1235L, 1488X (wherein X is an amino acid other than R), 1659X (wherein X is an amino acid other than K), 1689X (wherein X is an amino acid other than W), 422D, 490N, 943L, 1002L, 1161W and 1919G or comprising an antisense sequence of said contiguous nucleotides, wherein said sequence of contiguous nucleotides comprises a nucleotide sequence encoding said amino acid selected from the group consisting of 136I, 216S, 241T, 395K, 848T, 858H, 858F, 863P, 1449V, 996C, 1298F, 1298D, 1299F, 1461T, 1462V, 1464I, 1627K, 277X (wherein X is an amino acid other than R), 328X (wherein X is an amino acid other than Y), 395K, 459X (wherein X is an amino acid other than S), 693 X (wherein X is an amino acid other than E), 767X (wherein X is an amino acid other than I), 830X (wherein X is an amino acid other than R), 897X (wherein X is an amino acid other than W), 1200L, 1235L, 1488X (wherein X is an amino acid other than R), 1659X (wherein X is an amino acid other than K), 1689X (wherein X is an amino acid other than W), 422D, 490N, 943L, 1002L, 1161W and 1919G, thereby forming a complex when at least one nucleotide sequence encoding the Nav1.7 protein comprising said amino acid selected from the group consisting of 136I, 216S, 241T, 395K, 848T, 858H, 858F, 863P, 1449V, 996C, 1298F, 1298D, 1299F, 1461T, 1462V, 1464I, 1627K, 277X (wherein X is an amino acid other than R), 328X (wherein X is an amino acid other than Y), 395K, 459X (wherein X is an amino acid other than S), 693 X (wherein X is an amino acid other than E), 767X (wherein X is an amino acid other than I), 830X (wherein X is an amino acid other than R), 897X (wherein X is an amino acid other than W), 1200L, 1235L, 1488X (wherein X is an amino acid other than R), 1659X (wherein X is an amino acid other than K), 1689X (wherein X is an amino acid other than W), 422D, 490N, 943L, 1002L, 1161W and 1919G is present; and detecting the presence or absence of the complex, wherein detecting the presence of the complex determines that the human comprises the Nav1.7 protein comprising said amino acid selected from the group consisting of 136I, 216S, 241T, 395K, 848T, 858H, 858F, 863P, 1449V, 996C, 1298F, 1298D, 1299F, 1461T, 1462V, 1464I, 1627K, 277X (wherein X is an amino acid other than R), 328X (wherein X is an amino acid other than Y), 395K, 459X (wherein X is an amino acid other than S), 693 X (wherein X is an amino acid other than E), 767X (wherein X is an amino acid other than I), 830X (wherein X is an amino acid other than R), 897X (wherein X is an amino acid other than W), 1200L, 1235L, 1488X (wherein X is an amino acid other than R), 1659X (wherein X is an amino acid other than K), 1689X (wherein X is an amino acid other than W), 422D, 490N, 943L, 1002L, 1161W and 1919G. In some embodiments, the assaying comprises nucleic acid amplification and optionally one or more methods selected from sequencing, next generation sequencing, nucleic acid hybridization, and allele-specific amplification and/or wherein the assaying is performed in a multiplex format. In some embodiments, said biological sample comprises serum, blood, feces, tissue, a cell, urine and/or saliva of said human.

In some embodiments, said human is indicated as heterozygous for a nucleotide sequence encoding the Nav1.7 protein comprising said amino acid selected from the group consisting of 136I, 216S, 241T, 395K, 848T, 858H, 858F, 863P, 1449V, 996C, 1298F, 1298D, 1299F, 1461T, 1462V, 1464I, 1627K, 277X (wherein X is an amino acid other than R), 328X (wherein X is an amino acid other than Y), 395K, 459X (wherein X is an amino acid other than S), 693 X (wherein X is an amino acid other than E), 767X (wherein X is an amino acid other than I), 830X (wherein X is an amino acid other than R), 897X (wherein X is an amino acid other than W), 1200L, 1235L, 1488X (wherein X is an amino acid other than R), 1659X (wherein X is an amino acid other than K), 1689X (wherein X is an amino acid other than W), 422D, 490N, 943L, 1002L, 1161W and 1919G, optionally, wherein said human is further indicated as comprising the nucleotide sequence of SEQ ID NO: 76, or said human is indicated as homozygous for a nucleotide sequence encoding the Nav1.7 protein comprising said amino acid selected from the group consisting of 136I, 216S, 241T, 395K, 848T, 858H, 858F, 863P, 1449V, 996C, 1298F, 1298D, 1299F, 1461T, 1462V, 1464I, 1627K, 277X (wherein X is an amino acid other than R), 328X (wherein X is an amino acid other than Y), 395K, 459X (wherein X is an amino acid other than S), 693 X (wherein X is an amino acid other than E), 767X (wherein X is an amino acid other than I), 830X (wherein X is an amino acid other than R), 897X (wherein X is an amino acid other than W), 1200L, 1235L, 1488X (wherein X is an amino acid other than R), 1659X (wherein X is an amino acid other than K), 1689X (wherein X is an amino acid other than W), 422D, 490N, 943L, 1002L, 1161W and 1919G.

In some embodiments, said human is or has been further determined to be substantially resistant to a pain or itching treatment. In some embodiments, said human is receiving or has received a pain or anti-itching treatment or has reduced responsiveness to a pain or itching treatment. In some embodiments, said disease or condition is a pain or itching disease or condition. In some embodiments, said disease or condition is a channelopathy or associated with a channelopathy; or is selected from the group consisting of primary erythermalgia (PE), paroxysmal extreme pain disorder (PEPD) and channelopathy-associated insensitivity to pain (CIP). In some embodiments, said human has been diagnosed with a pain or itching disease or condition.

In some embodiments, said ligand fragment treats or reduces the risk in said human of a pain or itching disease or condition.

In some embodiments, the nucleotide sequence comprises one or more SNPs selected from the group consisting of rs6746030, rs3750904, rs58022607, rs4369876, rs13402180 and rs12478318.

In a Twenty-seventh Configuration, described herein is a method of treating or reducing the risk of a disease or condition mediated by VEGF-A in a human, the method comprising administering to said human an anti-VEGF-A ligand (eg, an anti-VEGF-A trap, antibody or antibody fragment) that specifically binds to a human VEGF-A that is expressed by a VEGF-A nucleotide sequence comprising a SNP selected from the group consisting of rs699947, rs833061, rs2010963, rs3025039, rs699946, rs2146323, rs1413711, rs833068, rs833069, rs3025000 and rs1570360, wherein said human comprises a VEGF-A nucleotide sequence comprising said selected SNP. The invention also provides a corresponding ligand, eg, antibody or antibody fragment, for use in such a method.

In a Twenty-eighth Configuration, described herein is a method of treating or reducing the risk of a disease or condition mediated by VEGF-A in a human, the method comprising administering to said human an anti-VEGF-A ligand (eg, an anti-VEGF-A trap, antibody or antibody fragment) that specifically binds to a human VEGF-A, wherein the human comprises (i) an ARMS2 nucleotide sequence comprising a G at the position of SNP rs10490924; (ii) a CFH nucleotide sequence comprising a T at the position of SNP rs1061170 or an T at the position of rs3766404; or (iii) a VEGFR2 nucleotide sequence comprising SNP rs4576072 or rs6828477, wherein the ligand comprises a human gamma-1 heavy chain constant region that comprises an amino acid selected from the group consisting of an Asp corresponding to position 204 of SEQ ID NO: 42 and a Leu corresponding to position 206 of SEQ ID NO: 42 and wherein said human comprises an IGHG1*01 human heavy chain constant region gene segment, or the human expresses antibodies comprising human gamma-1 heavy chain constant regions comprising said selected amino acid. These SNPs are associated with improved responses following anti-VEGF-A treatment of an ocular disease or condition. The invention also provides a corresponding ligand, eg, antibody or antibody fragment, for use in such a method.

In a Twenty-ninth Configuration, described herein is a method of treating or reducing the risk of a VEGF-A mediated disease or condition in a human, the method comprising administering an anti-human VEGF-A ligand to a human, wherein the human comprises (i) a PDGF-B nucleotide sequence comprising a SNP selected from the group consisting of rs142404523 (ie, a C corresponding to position −776) and a C at the position of rs1800818 (ie, a C corresponding to position −735); or (ii) a PDGFR-B nucleotide sequence comprising a SNP selected from the group consisting of rs246395 (ie, a G corresponding to position 2601) and rs74943037 (ie, a T corresponding to position 1391). The invention also provides a corresponding ligand, eg, antibody or antibody fragment, for use in such a method.

In an example of any of the 27-29th configurations, the ligand comprises an antibody constant region (eg, an antibody Fc region). Optionally, the ligand comprises a human gamma-1 heavy chain constant region that comprises an amino acid selected from the group consisting of an Asp corresponding to position 204 of SEQ ID NO: 42 and a Leu corresponding to position 206 of SEQ ID NO: 42 and wherein said human comprises an IGHG1*01 human heavy chain constant region gene segment, or the human expresses antibodies comprising human gamma-1 heavy chain constant regions comprising said selected amino acid.

In an example of any of the 27-29th configurations the disease or condition is an ocular condition or a cancer; or angiogenesis or neovascularisation.

In an example of any of the 27-29th configurations the method further comprises antagonising PDGF-B in said human.

In an example of any of the 27-29th configurations the method further comprises antagonising angiopoietin-2 (Ang2) in said human.

In a Thirtieth configuration, the invention provides:—

A method of treating or reducing the risk of a disease or condition mediated by PD-L1 in a human, the method comprising administering to said human an anti-PD-L1 ligand (eg, an anti-PD-L1 trap, antibody or antibody fragment) that specifically binds to a human PD-L1 that is expressed by a PD-L1 nucleotide sequence comprising a variation selected from the variations listed in Table 21.

For example, there is provided a method of treating or reducing the risk of a disease or condition mediated by PD-L1 in a human, the method comprising administering to said human an anti-PD-L1 ligand (eg, an anti-PD-L1 trap, antibody or antibody fragment) that specifically binds to a human PD-L1 that is expressed by a PD-L1 nucleotide sequence comprising a variation selected from the variations listed in Table 21, wherein said human comprises a PD-L1 nucleotide sequence comprising said selected variation.

For example, there is provided a method of treating or reducing the risk of a cancer in a human, the method comprising administering to said human an anti-PD-L1 ligand (eg, an anti-PD-L1 trap, antibody or antibody fragment) that specifically binds to a human PD-L1 that is expressed by a PD-L1 nucleotide sequence comprising a variation selected from the variations listed in Table 21, wherein said human comprises a PD-L1 nucleotide sequence comprising said selected variation.

For example, there is provided a method of treating or reducing the risk of an autoimmune disease or condition in a human, the method comprising administering to said human an anti-PD-L1 ligand (eg, an anti-PD-L1 trap, antibody or antibody fragment) that specifically binds to a human PD-L1 that is expressed by a PD-L1 nucleotide sequence comprising a variation selected from the variations listed in Table 21, wherein said human comprises a PD-L1 nucleotide sequence comprising said selected variation.

For example, there is provided a method of treating or reducing the risk inflamatory disease or condition in a human, the method comprising administering to said human an anti-PD-L1 ligand (eg, an anti-PD-L1 trap, antibody or antibody fragment) that specifically binds to a human PD-L1 that is expressed by a PD-L1 nucleotide sequence comprising a variation selected from the variations listed in Table 21, wherein said human comprises a PD-L1 nucleotide sequence comprising said selected variation.

In a Thirty-first configuration, the invention provides an anti-human PD-L1 ligand (eg, an antibody, antibody fragment or human PD-L1 trap) for use in a method of the Thirtieth configuration.

In a Thirty-second configuration the invention provides: A method of cancer immunotherapy in a human by targeting an immune cell TOI (eg, PD-1) in the human, the TOI being present in humans as a plurality of variants differing by one or more amino acid polymorphisms, the method comprising administering a ligand (eg, an antibody or antibody fragment) to the human, the ligand comprising first and second protein domains, wherein the first domain specifically binds a TOI variant comprising a first amino acid polymorphism, wherein the second domain comprises a second polymorphism, and wherein the human expresses (i) TOI comprising said first amino acid polymorphism; and (ii) protein domains comprising said second polymorphism, wherein the ligand comprises a human gamma-4 heavy chain constant region that comprises a Leu at position 189 shown in SEQ ID NO: 73 or an Arg at position 289 shown in SEQ ID NO: 73 and wherein said human comprises an IGHG4*01 human heavy chain constant region gene segment, or the human expresses antibodies comprising human gamma-4 heavy chain constant regions comprising a Leu at position 189 shown in SEQ ID NO: 73 or an Arg at position 289 shown in SEQ ID NO: 73; and wherein the second domain is comprised by said gamma-4 heavy chain constant region of the ligand.

This configuration also provides the following aspects:—

A method of cancer immunotherapy in a human by targeting PD-1 in the human, the method comprising administering an antibody or antibody fragment to the human, wherein the antibody or antibody fragment specifically binds a PD-1 encoded by a PD-1 nucleotide sequence comprising a SNP selected from the group consisting of the variations set out in Table 23, wherein the antibody or antibody fragment comprises a human gamma-4 heavy chain constant region that comprises a Leu at position 189 shown in SEQ ID NO: 73 or an Arg at position 289 shown in SEQ ID NO: 73 and wherein said human comprises (i) an IGHG4*01 human heavy chain constant region gene segment, or the human expresses antibodies comprising human gamma-4 heavy chain constant regions comprising a Leu at position 189 shown in SEQ ID NO: 73 or an Arg at position 289 shown in SEQ ID NO: 73; and (ii) a PD-1 nucleotide sequence comprising said selected SNP.

A method of cancer immunotherapy in a human by targeting PD-1 in the human, the method comprising administering an antibody or antibody fragment to the human, wherein the antibody or antibody fragment specifically binds a PD-1 encoded by a PD-1 nucleotide sequence comprising a SNP (first polymorphism) selected from the group consisting of the variations set out in Table 23 (eg, selected from the group consisting of rs36084323, rs10204225, rs11568821, rs2227981 and rs2227982), wherein the antibody or antibody fragment comprises a human gamma-4 heavy chain constant region that comprises a Leu at position 189 shown in SEQ ID NO: 73 or an Arg at position 289 shown in SEQ ID NO: 73 and wherein said human comprises (i) an IGHG4*01 human heavy chain constant region gene segment, or the human expresses antibodies comprising human gamma-4 heavy chain constant regions comprising a Leu at position 189 shown in SEQ ID NO: 73 or an Arg at position 289 shown in SEQ ID NO: 73; and (ii) a PD-1 nucleotide sequence comprising said selected SNP.

A method of treating cancer in a human, the method comprising administering an antibody or antibody fragment to the human, wherein the antibody or antibody fragment inhibits the binding of PD-L1 or PD-L2 to a PD-1 comprising a first amino acid polymorphism, wherein the antibody or antibody fragment comprises a human gamma-4 heavy chain constant region that comprises a Leu at position 189 shown in SEQ ID NO: 73 or an Arg at position 289 shown in SEQ ID NO: 73 and wherein said human comprises (i) an IGHG4*01 human heavy chain constant region gene segment, or the human expresses antibodies comprising human gamma-4 heavy chain constant regions comprising a Leu at position 189 shown in SEQ ID NO: 73 or an Arg at position 289 shown in SEQ ID NO: 73; and (ii) a PD-1 nucleotide sequence encoding a PD-1 comprising said first amino acid polymorphism or the human expresses a PD-1 comprising said first amino acid polymorphism.

In an alternative, instead of "A method of cancer immunotherapy" or "A method of treating cancer", the invention instead provides "A method of treating or reducing the risk of an autoimmune disease or condition" or "A method of treating or reducing the risk inflammatory disease or condition" and the TOI polymorphism is associated with an autoimmune or inflammatory disease or condition.

The invention also provides a ligand (eg, a trap, an antibody or antibody fragment) for use in any of the methods.

In a Thirty-third configuration the invention provides: A method of treating or reducing the risk of a disease or condition (eg, anaemia) in a human, wherein the disease or condition is mediated by a TOI, the TOI being present in humans as a plurality of variants differing by one or more amino acid polymorphisms, the method comprising administering a ligand (eg, an antibody or antibody fragment) to the human, the ligand comprising first and second protein domains, wherein the first domain specifically binds a TOI variant comprising a first amino acid polymorphism, wherein the second domain comprises a second polymorphism, and wherein the human expresses (i) TOI comprising said first amino acid polymorphism; and (ii) protein domains comprising said second polymorphism, optionally wherein the ligand comprises a human gamma-4 heavy chain constant region that comprises a Leu at position 189 shown in SEQ ID NO: 73 or an Arg at position 289 shown in SEQ ID NO: 73 and wherein said human comprises an IGHG4*01 human heavy chain constant region gene segment, or the human expresses antibodies comprising human gamma-4 heavy chain constant regions comprising a Leu at position 189 shown in SEQ ID NO: 73 or an Arg at position 289 shown in SEQ ID NO: 73; and wherein the second domain is comprised by said gamma-4 heavy chain constant region of the ligand; wherein, the TOI is selected from the human hemojuvelin-BMP6-TMPRSS6-hepcidin-ferroportin-transferrin axis.

Examples of any configuration or relating to any TOI are as follows:—
(i) wherein the ligand comprises a VH domain derived from the recombination of a human VH segment (eg, human VH3-23*04), a human D gene segment and a human JH segment, the human VH segment encoding the framework 1 of SEQ ID NO: 40 and wherein said human comprises a VH gene segment encoding the framework 1 of SEQ ID NO: 40, or the human expresses VH domains that comprise the framework 1 of SEQ ID NO: 40.

(ii) wherein the ligand comprises a VH domain derived from the recombination of human VH segment IGHV3-7*01, a human D gene segment and a human JH segment, and wherein said human comprises a IGHV3-7*01 VH gene segment or the human expresses VH domains derived from the recombination of human VH segment IGHV3-7*01, a human D gene segment and a human JH segment.

(iii) wherein the ligand comprises a Vκ domain derived from the recombination of human Vκ segment IGKV1-12*01 and a human Jκ segment, and wherein said human comprises a IGKV1-12*01 Vκ gene segment or the human expresses Vκ domains derived from the recombination of human Vκ segment IGKV1-12*01 and a human Jκ segment.

(iv) wherein the ligand comprises a Vκ domain derived from the recombination of a human Vκ segment and a human Jκ segment, the human Vκ segment encoding (i) a CDR3 comprising a Pro at position 7 shown in SEQ ID NO: 36 and wherein said human comprises a Vκ gene segment encoding a CDR3 comprising a Pro at position 7 shown in SEQ ID NO: 36, or the human expresses Vκ domains that comprise a CDR3 comprising a Pro at position 7 shown in SEQ ID NO: 36; or (ii) a FW3 comprising a Ser at position 15 shown in SEQ ID NO: 38 and wherein said human comprises a Vκ gene segment encoding a FW3 comprising a Ser at position 15 shown in SEQ ID NO: 38 or the human expresses Vκ domains that comprise a FW3 comprising a Ser at position 15 shown in SEQ ID NO: 38.

(v) wherein the ligand comprises a human gamma-1 heavy chain constant region that comprises an Asp at position 204 shown in SEQ ID NO: 4 or a Leu at position 206 shown in SEQ ID NO: 4 and wherein said human comprises (i) an IGHG1*01 human heavy chain constant region gene segment, or the human expresses antibodies comprising human gamma-1 heavy chain constant regions comprising an Asp at position 204 shown in SEQ ID NO: 4 or a Leu at position 206 shown in SEQ ID NO: 4.

(vi) wherein the ligand comprises a human gamma-2 heavy chain constant region that comprises an amino acid selected from the group consisting of a Pro at position 72 shown in SEQ ID NO: 6, an Asn at position 75 shown in SEQ ID NO: 6, a Phe at position 76 shown in SEQ ID NO: 6, a Val at position 161 shown in SEQ ID NO: 6 and an Ala at position 257 shown in SEQ ID NO: 6 and wherein said human comprises (i) an IGHG2*01 human heavy chain constant region gene segment, or the human expresses antibodies comprising human gamma-2 heavy chain constant regions comprising said selected Pro at position 72 shown in SEQ ID NO: 6, Asn at position 75 shown in SEQ ID NO: 6, Phe at position 76 shown in SEQ ID NO: 6, Val at position 161 shown in SEQ ID NO: 6 or Ala at position 257 shown in SEQ ID NO: 6.

(vii) wherein the ligand comprises a human kappa chain constant region that comprises a Val at position 84 shown in SEQ ID NO: 16 or a Cys at position 87 shown in SEQ ID NO: 16 and wherein said human comprises (i) an IGKC1*01 human kappa chain constant region gene segment, or the human expresses antibodies comprising human kappa chain constant regions comprising a Val corresponding to position 84 shown in SEQ ID NO: 16 or a Cys at position 87 shown in SEQ ID NO: 16.

(viii) wherein the ligand comprises a human IGLC1*01 lambda chain constant region and wherein said human comprises (i) a human IGLC1*01 lambda chain constant region gene segment, or the human expresses antibodies comprising human IGLC1*01 lambda chain constant regions.

(ix) wherein the ligand comprises a human gamma-4 heavy chain constant region that comprises a Leu at position 189 shown in SEQ ID NO: 73 or an Arg at position 289 shown in SEQ ID NO: 73 and wherein said human comprises (i) an IGHG4*01 human heavy chain constant region gene segment, or the human expresses antibodies comprising human gamma-4 heavy chain constant regions comprising a Leu at position 189 shown in SEQ ID NO: 73 or an Arg at position 289 shown in SEQ ID NO: 73.

(x) wherein the ligand comprises a human gamma-3 heavy chain constant region encoded by a first human IGHG3 (eg, IGHG3*01) constant region gene segment and wherein said human comprises (i) said first constant region gene segment (eg, an IGHG3*01), or the human expresses antibodies comprising human gamma-3 heavy chain constant regions encoded by said first human IGHG3 (eg, IGHG3*01) constant region gene segment.

(xi) wherein the ligand comprises a human epsilon heavy chain constant region encoded by a first human epsilon heavy chain constant region gene segment and wherein said human comprises (i) said first constant region gene segment, or the human expresses antibodies comprising human epsilon heavy chain constant regions encoded by said first constant region gene segment.

(xii) wherein the ligand comprises a human mu heavy chain constant region encoded by a first human mu heavy chain constant region gene segment and wherein said human comprises (i) said first constant region gene segment, or the human expresses antibodies comprising human mu heavy chain constant regions encoded by said first constant region gene segment.

(xiii) wherein the ligand comprises a human alpha heavy chain constant region encoded by a first human alpha heavy chain constant region gene segment and wherein said human comprises (i) said first constant region gene segment, or the human expresses antibodies comprising human alpha heavy chain constant regions encoded by said first constant region gene segment.

(xiv) wherein the ligand comprises a human delta heavy chain constant region encoded by a first human delta heavy chain constant region gene segment and wherein said human comprises (i) said first constant region gene segment, or the human expresses antibodies comprising human delta heavy chain constant regions encoded by said first constant region gene segment.

(xv) wherein the ligand comprises a human kappa light chain constant region encoded by a first human kappa light chain constant region gene segment and wherein said human comprises (i) said first constant region gene segment, or the human expresses antibodies comprising human kappa light chain constant regions encoded by said first constant region gene segment.

(xvi) wherein the ligand comprises a human lambda light chain constant region encoded by a first human lambda light chain constant region gene segment and wherein said human comprises (i) said first constant region gene segment, or the human expresses antibodies comprising human lambda light chain constant regions encoded by said first constant region gene segment.

In some embodiments, said ligand (eg, antibody or antibody fragment) is administered by inhaled, intravenous or subcutaneous administration and/or is comprised in an inhalable or injectable preparation.

In some embodiments, the human gamma-4 heavy chain constant region of the ligand comprises the amino acid sequence of SEQ ID NO: 73 or an ADCC inactivated version thereof.

In some embodiments, the human gamma-4 heavy chain constant region comprises 228P and 235E.

Optionally in the present invention the TOI is selected from the group consisting of human TOIs: PCSK9, IL6R, IL4Ra, VEGF-A, Placental growth factor (PGF), PDGF-B, PDGFR-B, Ang-2, Nav1.7, Nav1.8, Nav1.9, PD-1, PD-L1, ICOS, BMP6, hemojuvelin, ferroportin, TMPRSS6, transferrin, human hemochromatosis protein (HFE) and sclerostin.

For example, the TOI is PCSK9.
For example, the TOI is IL6R.
For example, the TOI is IL4Ra.
For example, the TOI is VEGF-A.
For example, the TOI is Placental growth factor (PGF).
For example, the TOI is PDGF-B.
For example, the TOI is PDGFR-B.
For example, the TOI is Ang-2.
For example, the TOI is Nav1.7.
For example, the TOI is Nav1.8.
For example, the TOI is Nav1.9.
For example, the TOI is PD-1.
For example, the TOI is PD-L1.
For example, the TOI is ICOS.
For example, the TOI is BMP6.
For example, the TOI is hemojuvelin.
For example, the TOI is ferroportin.
For example, the TOI is TMPRSS6.
For example, the TOI is transferrin.
For example, the TOI is human hemochromatosis protein (HFE).
For example, the TOI is sclerostin.

In a Thirty-fourth configuration, described herein is a method of treating or reducing the risk of a Nav1.8-mediated disease or condition (eg, a pain or cardiac condition) in a human in need thereof, the method comprising administering to said human a ligand (eg, an antibody or antibody fragment) that specifically binds a human Nav1.8 protein that comprises an amino acid selected from the group consisting of L554P, A1304T, I1706V, A1073V, G1662S, L1092P, I962V, S509P, I206M and R90W or an amino acid encoded by a SNP selected from the group consisting of rs6801957, rs6795970, rs10428132, rs12632942, rs57326399, rs7630989, rs74717885 and rs144270136; optionally selected from the group consisting of L554P, A1304T, I1706V and G1662S (eg, when the condition is neuropathic pain); wherein (i) the ligand comprises a human gamma-4 heavy chain constant region that comprises a Leu at position 189 shown in SEQ ID NO: 73 or an Arg at position 289 shown in SEQ ID NO: 73 and wherein said human comprises (i) an IGHG4*01 human heavy chain constant region gene segment, or the human expresses antibodies comprising human gamma-4 heavy chain constant regions comprising a Leu at position 189 shown in SEQ ID NO: 73 or an Arg at position 289 shown in SEQ ID NO: 73; and wherein (ii) said human comprises a nucleotide sequence encoding said Nav1.8 protein comprising said selected amino acid. The invention also provides a corresponding ligand, eg, antibody or antibody fragment, for use in such a method.

In alternative embodiments, a VH or VL domain of the ligand (eg, antibody) and/or a different constant region is matched according to the invention.

In a Thirty-fifth configuration, described herein is a method of treating or reducing the risk of a Nav1.9-mediated disease or condition (eg, a pain condition) in a human in need thereof, the method comprising administering to said human a ligand (eg, an antibody or antibody fragment) that specifically binds a human Nav1.8 protein that comprises an amino acid selected from the group consisting of I381T, K419N, A582T, A681D, A842P, L1158P, F1689L, L811P, R225C, A808G, V909I, R86G, T1609I and G481E; wherein (i) the ligand comprises a human gamma-4 heavy chain constant region that comprises a Leu at position 189 shown in SEQ ID NO: 73 or an Arg at position 289 shown in SEQ ID NO: 73 and wherein said human comprises (i) an IGHG4*01 human heavy chain constant region gene segment, or the human expresses antibodies comprising human gamma-4 heavy chain constant regions comprising a Leu at position 189 shown in SEQ ID NO: 73 or an Arg at position 289 shown in SEQ ID NO: 73; and wherein (ii) said human comprises a nucleotide sequence encoding said Nav1.8 protein comprising said selected amino acid. The invention also provides a corresponding ligand, eg, antibody or antibody fragment, for use in such a method.

In alternative embodiments, a VH or VL domain of the ligand (eg, antibody) and/or a different constant region is matched according to the invention.

BRIEF DESCRIPTION OF THE DRAWINGS

This patent or application file contains at least one drawing executed in color. Copies of this patent or patent application publication with color drawing(s) will be provided by the Office upon request and payment of the necessary fee.

FIG. 3 depicts frameworks and CDRs encoded by VH3-23*04 as obtained from the IMGT database (available on the World Wide Web at www.IMGT.org). FIG. 3 discloses the nucleotide sequences as SEQ ID NOS 117, 117, 117, 119, 119, 119, 120, 122, 124, 39 and 125, respectively, in order of appearance. FIG. 3 discloses the coded amino acid sequences as SEQ ID NOS 118, 118, 118, 118, 118, 118, 121, 123, 123, 38 and 126, respectively, in order of appearance.

FIG. 4 depicts sequences of VH3-23*04. The portion of VH3-23*04 comprising the FW1 residue change of rs56069819 (SEQ ID NO: 38). The portion of the nucleic acid sequence encoding rs56069819 is depicted (SEQ ID NO: 39). The FW1 encoded by VH3-23*04 is depicted (SEQ ID NO: 40).

DETAILED DESCRIPTION

Figure 1:
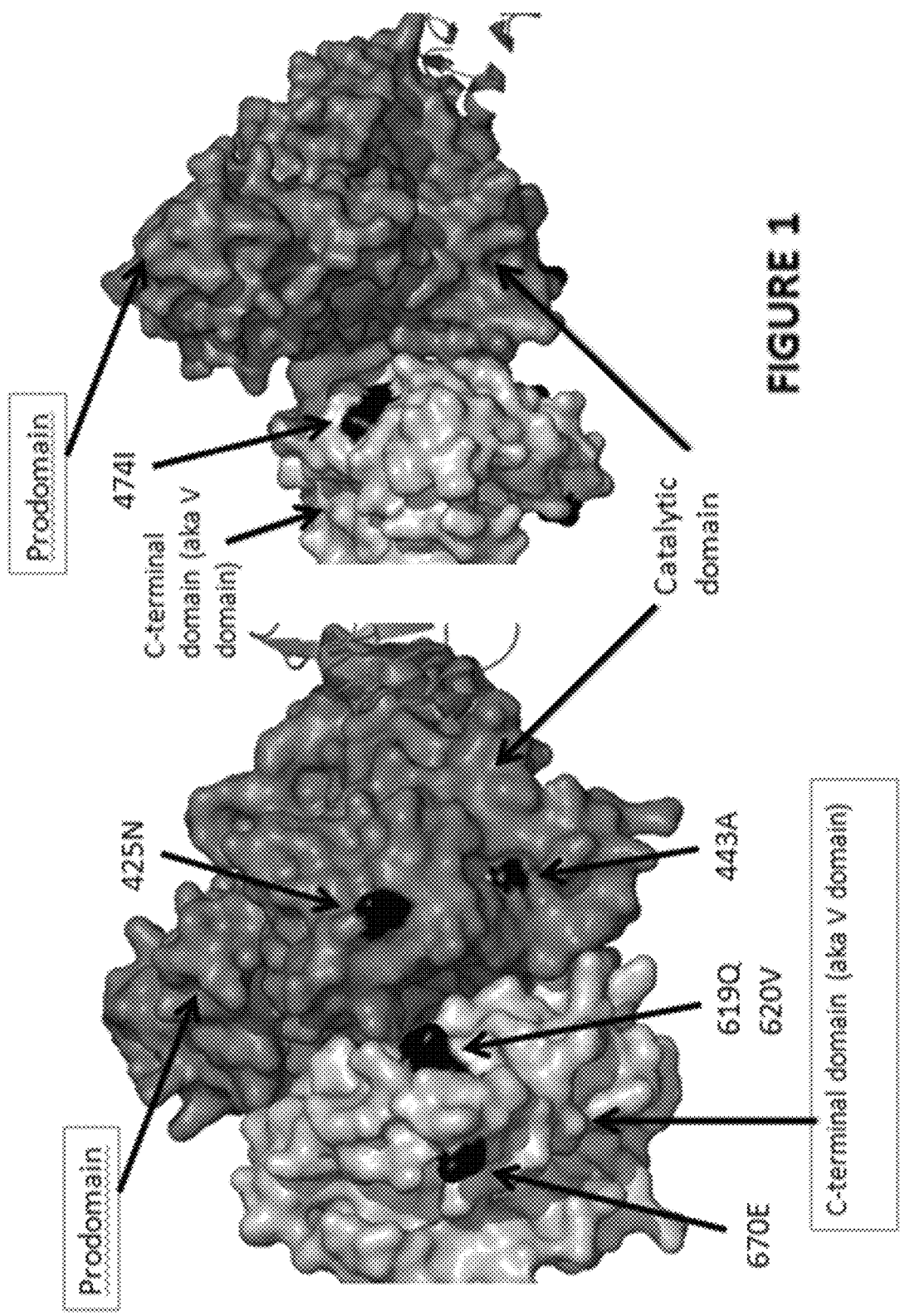
FIG. 1 shows in silico modeling of PCSK9 surface variant residues.

The skilled person will know that SNPs or other changes that translate into amino acid variation can cause variability in conformation or activity of human targets to be addressed. This has spawned great interest in personalized medicine where genotyping and knowledge of protein and nucleotide variability is used to tailor medicines and diagnosis of patients more effectively. The present invention provides for tailored pharmaceuticals and testing that specifically addresses rarer variant forms of a human target of interest (TOI).

The present invention harnesses the power of human genetic variation analysis and rationally-designed sequence selection. The technical applications of these approaches, as per the present invention, contribute to better treatment, prophylaxis and diagnosis in humans and provides for patient benefit by providing choice and enabling personalized medicines and therapies. This provides advantages of better prescribing, less wastage of medications and improved chances of drug efficacy and better diagnosis in patients.

As sources of genomic sequence variation data, the skilled person will be aware of the available databases and resources (including updates thereof) provided by the following:—
1. HapMap (The International HapMap Consortium. 2003; available on the World Wide Web at hapmap.ncbi.nlm.nih.gov/index.html.en). The HapMap Project is an international project that aims to compare the genetic sequences of different individuals to identify chromosomal regions containing shared genetic variants. The HapMap www site provides tools to identify chromosomal regions and the variant therein, with options to drill down to population level frequency data.
2. 1000 Genomes Project (The 1000 Genomes Project Consortium 2010; available on the World Wide Web at 1000genomes.org/). This resource provides complete genomic sequence for at least 2500 unidentified individuals from one of 25 distinct population groups.
3. Japanese SNP Database (H.Haga et al. 2002; available on the World Wide Web at snp.ims.u-tokyo.ac.jp/index.html). Based on a study identifying 190,562 human genetic variants.

The present invention involves the identification and cataloguing of naturally-occurring human genomic target sequence variants, including those found to be relatively low-frequency or rare variants that segregate with specific human ethnic populations and in many individual humans.

An aspect of the invention is based on rational design of sequence selection addressing the desirability to tailor medicaments and diagnostics to rarer, but yet still significant groups of human individuals that suffer from, or have the potential to suffer from (ie, who are at risk of), a disease or condition mediated or associated with the target of interest. In devising this rational design of the present aspect of the invention, the inventor included considerations of the spread of prevalence of naturally-occurring target variant sequences across multiple, diverse human ethnic populations, as well as the importance of addressing such populations where many individuals are likely to display a genotype and/or phenotype of one or more of the variants being analysed. As part of this design, the inventor saw the importance of adopting the art-recognised classifications of human ethnic populations, and in this respect the inventor based the analysis and design on the recognised human ethnic populations adopted by the 1000 Genomes Project, since this is a resource that is, and will continue to be, widely adopted by the scientific and medical community.

Thus, in this aspect of the invention, the inventor designed the following variant sequence selection criteria, these being criteria that the inventor realised would provide for useful medical drugs and diagnostics to tailored need in the human population.

Selection Criteria

Three or four of the following:—
Naturally-occurring human target variant sequences having a cumulative human allele frequency of 35% or less;
Naturally-occurring human target variant sequences having a total human genotype frequency of 40% or less;
Naturally-occurring human target variant sequences found in many different human ethnic populations (using the standard categorisation of the 1000 Genomes Project; see Table 4 below); and
Naturally-occurring human target variant sequences found in many individuals distributed across such many different ethnic populations.

The inventor's selection included, as a consideration, selection for nucleotide variation that produced amino acid variation in corresponding TOI forms (ie, non-synonymous variations), as opposed to silent variations that do not alter amino acid residues in the target protein.

In an embodiment, the cumulative human allele frequency is 30, 25, 20, 15, 10 or 5% or less, eg, in the range from 1 to 20% or 1 to 15% or 1 to 10%.

In an embodiment, the total human genotype frequency is 35, 30, 25, 20, 15, 10 or 5% or less, eg, in the range from 1 to 25%, 1 to 20%, 1 to 15%, 1 to about 15%, 1 to 10%, 1 to about 10% or 1 to 5% or 1 to about 5%.

In an embodiment, the naturally-occurring human target variant sequences are found in at least 9, 10, 11, 12, 13, 14, 15, 16, 17, 18, 19 or 20 different human ethnic populations (using the standard categorisation of the 1000 Genomes Project).

In an embodiment, the naturally-occurring human target variant sequences are found in at least 20, 25, 30, 35, 40, 45, 50, 55, 60, 65, 70, 75, 80, 85, 90, 95, 100, 105, 110, 115, 120, 130, 140 or 150 individuals distributed across such many different ethnic populations.

In an example, the following criteria are applied:—
Naturally-occurring human target variant sequences having a cumulative human allele frequency of 15% or less;
Naturally-occurring human target variant sequences having a total human genotype frequency of 20% or less;
Naturally-occurring human target variant sequences found in at least 5 different human ethnic populations (using the standard categorisation of the 1000 Genomes Project); and
Naturally-occurring human target variant sequences found in many individuals distributed across such many different ethnic populations.

In an example, the criteria are applied with reference to one or more human genomic sequence databases as described herein. For example, the criteria are those as applied to the 1000 Genomes database.

For example in any aspect example, embodiment or configuration of the invention, the 1000 Genomes database release 13. For example, the 1000 Genomes database in its most recent version as at 1 Oct. 2013.

Optionally, further sequence analysis and 3D in silico modelling (eg, see FIG. 1) can also be used as an additional selection criterion: variants whose variant amino acid residues (versus the most common form of human TOI) are surface-exposed on the target are desirable for selection, since the inventor saw these as contributing to determining the topography of the target and potentially contributing to how and where ligand binding on the target occurs.

The following bioinformatics protocol is envisaged to indentify human sequences for use in the present invention:
(a) Identify a genomic region containing a target sequence of interest ('target genomic region') and calculate the genomic coordinates, using coordinates that match the sequence assembly build used by either the 1000 Genomes Project or International HapMap project (or another selected human gene database of choice).

(b) Identify genomic variants mapped to the genomic region previously identified in (a). Retrieve allele frequencies for variants for each super population and preferably sub-population where such data is available. The VWC tools for the 1000 Genomes Project can be used for this step.

(c) Filter list of genomic variants from target genomic region to contain only variants classed as either 'non-synonymous' single nucleotide polymorphisms (SNPs) or genomic 'insertions or delections' (indels). Filter further to include those that are present in exonic sequences only. "Non-synonymous" refers to nucleotide variation that produces amino acid variation (ie, excluding silent mutations).

(d) Correlate population frequency data for each of the identified variants for each of the super populations (for example 'European Ancestry', 'East Asian ancestry', 'West African ancestry', 'Americas', and 'South Asian ancestry') to identify those variants that segregate with less than two super-populations. Further correlate all identified variants with each of the sub-populations (for example, 'European ancestry' super-population might be subdivided into groups such as 'CEU—Utah residents with Northern or Western European ancestry', 'TSI Toscani in Italia' and 'British from England and Scotland') and produce a second score for rarity of variants within a super-population.

(e) Collect one or more sequences that show segregation to specific sub-populations for use in the present invention, eg, according to selection criteria as described herein.

Human Populations

Optionally the ethnic populations are selected from those identified in the 1000 Genomes Project database. In this respect, see Table 4 which provides details of the ethnic populations on which the 1000 Genomes Project database is based.

N A Rosenberg et al (Science 20 Dec. 2002: vol. 298 no. 5602 2342-2343) studied the genetic structure of human populations of differing geographical ancestry. In total, 52 populations were sampled, these being populations with:

African Ancestry (Mbuti Pygmies, Biaka Pygmies, San peoples, and speakers of *Niger*-Kordofanian languages (Bantu, Yoruba or Mandenka populations), Eurasian Ancestry (European ancestry (Orcadian, Adygel, Basque, French, Russians, Italians, Sardinian, Tuscan), Middle Eastern ancestry (Mozabite, Bedouin, Druze, Palestinians), Central/South Asian ancestry (Balochl, Brahul, Makrani, Sindhi, Pathan, Burusho, Hazara, Uygur, Kalash)), East Asian Ancestry (Han, Dal, Daur, Hezhen, Lahu, Miao, Orogen, She, Tujia, Tu, Xibo, Yi, Mongola, Naxi, Cambodian, Japanese, Yakut), Oceanic ancestry (Melanesian, Papuan); or Americas Ancestry (Karitiana, Surui, Colombian, Maya, Pima).

The International HapMap Project, Nature, 2003 Dec. 18; 426(6968):789-96, discloses that goal of the HapMap Project: to determine the common patterns of DNA sequence variation in the human genome by determining the genotypes of one million or more sequence variants, their frequencies and the degree of association between them in DNA samples from populations with ancestry from parts of Africa, Asia and Europe. The relevant human populations of differing geographical ancestry include Yoruba, Japanese, Chinese, Northern European and Western European populations. More specifically:—

Utah population with Northern or Western European ancestry (samples collected in 1980 by the Centre d'Etude du Polymorphisme Humain (CEPH));

population with ancestry of Yoruba people from Ibadan, Nigeria;

population with Japanese ancestry; and population with ancestry of Han Chinese from China.

The authors, citing earlier publications, suggest that ancestral geography is a reasonable basis for sampling human populations.

A suitable sample of human populations used in the present invention is as follows:—

(a) European ancestry (b) Northern European ancestry; Western European ancestry; Toscani ancestry; British ancestry, Finnish ancestry or Iberian ancestry.

(c) More specifically, population of Utah residents with Northern and/or Western European ancestry; Toscani population in Italia; British population in England and/or Scotland; Finnish population in Finland; or Iberian population in Spain.

(a) East Asian ancestry (b) Japanese ancestry; Chinese ancestry or Vietnamese ancestry.

(c) More specifically, Japanese population in Toyko, Japan; Han Chinese population in Beijing, China; Chinese Dai population in Xishuangbanna; Kinh population in Ho Chi Minh City, Vietnam; or Chinese population in Denver, Colo., USA.

(a) West African ancestry (b) Yoruba ancestry; Luhya ancestry; Gambian ancestry; or Malawian ancestry.

(c) More specifically, Yoruba population in Ibadan, Nigeria; Luhya population in Webuye, Kenya; Gambian population in Western Division, The Gambia; or Malawian population in Blantyre, Malawi.

(a) Population of The Americas (b) Native American ancestry; Afro-Caribbean ancestry; Mexican ancestry; Puerto Rican ancestry; Columbian ancestry; or Peruvian ancestry.

(c) More specifically, population of African Ancestry in Southwest US; population of African American in Jackson, Miss.; population of African Caribbean in Barbados; population of Mexican Ancestry in Los Angeles, Calif.; population of Puerto Rican in Puerto Rico; population of Colombian in Medellin, Colombia; or population of Peruvian in Lima, Peru.

(a) South Asian ancestry (b) Ahom ancestry; Kayadtha ancestry; Reddy ancestry; Maratha; or Punjabi ancestry.

(c) More specifically, Ahom population in the State of Assam, India; Kayadtha population in Calcutta, India; Reddy population in Hyderabad, India; Maratha population in Bombay, India; or Punjabi population in Lahore, Pakistan.

In any configuration of the invention, in one embodiment, each human population is selected from a population marked "(a)" above.

In any configuration of the invention, in another embodiment, each human population is selected from a population marked "(b)" above.

In any configuration of the invention, in another embodiment, each human population is selected from a population marked "(c)" above.

In one embodiment the ethnic populations are selected from the group consisting of an ethnic population with European ancestry, an ethnic population with East Asian, an ethnic population with West African ancestry, an ethnic population with Americas ancestry and an ethnic population with South Asian ancestry.

In one embodiment the ethnic populations are selected from the group consisting of an ethnic population with Northern European ancestry; or an ethnic population with Western European ancestry; or an ethnic population with Toscani ancestry; or an ethnic population with British ancestry; or an ethnic population with Icelandic ancestry; or an ethnic population with Finnish ancestry; or an ethnic population with Iberian ancestry; or an ethnic population with Japanese ancestry; or an ethnic population with Chinese ancestry; or an ethnic population Vietnamese ancestry; or an ethnic population with Yoruba ancestry; or an ethnic population with Luhya ancestry; or an ethnic population with Gambian ancestry; or an ethnic population with Malawian ancestry; or an ethnic population with Native American ancestry; or an ethnic population with Afro-Caribbean ancestry; or an ethnic population with Mexican ancestry; or an ethnic population with Puerto Rican ancestry; or an ethnic population with Columbian ancestry; or an ethnic population with Peruvian ancestry; or an ethnic population with Ahom ancestry; or an ethnic population with Kayadtha ancestry; or an ethnic population with Reddy ancestry; or an ethnic population with Maratha; or an ethnic population with Punjabi ancestry.

Anti-Target Ligands

The invention provides useful anti-target ligands for addressing humans suffering from or likely to suffer from a disease or condition mediated or associated with the TOI. For example, the ligand specifically binds to the TOI variant as per the invention. The ligand may inhibit or antagonise the activity of the target, eg, the ligand neutralises the target. The skilled person will be familiar with neutralising ligands in general, such as antibodies or antibody fragments, and can readily test suitable ligands for specific binding and/or neutralisation of a target in vitro or in an in vivo assay.

An antibody "fragment" comprises a portion intact antibody, preferably the antigen binding and/or the variable region of the intact antibody. Examples of antibody fragments include dAb, Fab, Fab', F(ab')2 and Fv fragments; diabodies; linear antibodies; single-chain antibody molecules and multispecific antibodies formed from antibody fragments.

In an embodiment, the ligand of the invention is or comprises an antibody or antibody fragment, for example an antibody or fragment comprising human variable regions (and optionally also human constant regions). Anti-TOI or TOI-binding or targeting antibodies and fragments can be prepared according to any known method, eg, using transgenic mice (eg, the Kymouse™ or Velocimouse™, or Omnimouse™, Xenomouse™, HuMab Mouse™ or MeMo Mouse™), rats (eg, the Omnirat™), camelids, sharks, rabbits, chickens or other non-human animals immunised with the TOI followed optionally by humanisation of the constant regions and/or variable regions to produce human or humanised antibodies. In an example, display technologies can be used, such as yeast, phage or ribosome display, as will be apparent to the skilled person. Standard affinity maturation, eg, using a display technology, can be performed in a further step after isolation of an antibody lead from a transgenic animal, phage display library or other library. Representative examples of suitable technologies are described in US20120093818 (Amgen, Inc), which is incorporated herein by reference, eg, the methods set out in paragraphs [0309] to [0346]. Although this is with reference to PCSK9, the antibody-generating methods can be applied to other TOIs as per the broadest scopes of the present invention.

Generally, a VELOCIMMUNE™ or other mouse or rat can be challenged with the antigen of interest, and lymphatic cells (such as B-cells) are recovered from the mice that express antibodies. The lymphatic cells may be fused with a myeloma cell line to prepare immortal hybridoma cell lines, and such hybridoma cell lines are screened and selected to identify hybridoma cell lines that produce antibodies specific to the antigen of interest. DNA encoding the variable regions of the heavy chain and light chain may be isolated and linked to desirable isotypic constant regions of the heavy chain and light chain. Such an antibody protein may be produced in a cell, such as a CHO cell. Alternatively, DNA encoding the antigen-specific chimaeric antibodies or the variable domains of the light and heavy chains may be isolated directly from antigen-specific lymphocytes.

Initially, high affinity chimaeric antibodies are isolated having a human variable region and a mouse constant region. As described below, the antibodies are characterized and selected for desirable characteristics, including affinity, selectivity, epitope, etc. The mouse constant regions are replaced with a desired human constant region to generate the fully human antibody of the invention, for example wild-type or modified IgG1 or IgG4 (for example, SEQ ID NO: 751, 752, 753 in US2011/0065902, which sequences are incorporated herein by reference for use in the ligands of the present invention). While the constant region selected may vary according to specific use, high affinity antigen-binding and target specificity characteristics reside in the variable region.

In an example, the ligand of the invention is or comprises a nucleic acid, eg, RNA, eg, siRNA that hybridises under stringent condition to the TOI variant sequence, eg, hybridises a nucleotide sequence comprising one or more nucleotides that are variant (versus the most common TOI sequence, eg, with reference to the 1000 Genomes Project database).

Target binding ability, specificity and affinity (Kd, $K_{off}$ and/or $K_{on}$) can be determined by any routine method in the art, eg, by surface plasmon resonance (SPR). The term "Kd", as used herein, is intended to refer to the equilibrium dissociation constant of a particular antibody-antigen interaction.

In one embodiment, the surface plasmon resonance (SPR) is carried out at 25° C. In another embodiment, the SPR is carried out at 37° C.

In one embodiment, the SPR is carried out at physiological pH, such as about pH7 or at pH7.6 (eg, using Hepes buffered saline at pH7.6 (also referred to as HBS-EP)).

In one embodiment, the SPR is carried out at a physiological salt level, eg, 150 mM NaCl.

In one embodiment, the SPR is carried out at a detergent level of no greater than 0.05% by volume, eg, in the presence of P20 (polysorbate 20; eg, Tween-20™) at 0.05% and EDTA at 3 mM.

In one example, the SPR is carried out at 25° C. or 37° C. in a buffer at pH7.6, 150 mM NaCl, 0.05% detergent (eg, P20) and 3 mM EDTA. The buffer can contain 10 mM Hepes. In one example, the SPR is carried out at 25° C. or 37° C. in HBS-EP. HBS-EP is available from Teknova Inc (California; catalogue number H8022).

In an example, the affinity of the ligand (eg, antibody) is determined using SPR by 1. Coupling anti-mouse (or other relevant human, rat or non-human vertebrate antibody constant region species-matched) IgG (eg, Biacore™ BR-1008-38) to a biosensor chip (eg, GLM chip) such as by primary amine coupling;

2. Exposing the anti-mouse IgG (or other matched species antibody) to a test IgG antibody to capture test antibody on the chip;
3. Passing the test antigen over the chip's capture surface at 1024 nM, 256 nM, 64 nM, 16 nM, 4 nM with a 0 nM (i.e. buffer alone); and
4. And determining the affinity of binding of test antibody to test antigen using surface plasmon resonance, eg, under an SPR condition discussed above (eg, at 25° C. in physiological buffer). SPR can be carried out using any standard SPR apparatus, such as by Biacore™ or using the ProteOn XPR36™ (Bio-Rad®).

Regeneration of the capture surface can be carried out with 10 mM glycine at pH1.7. This removes the captured antibody and allows the surface to be used for another interaction. The binding data can be fitted to 1:1 model inherent using standard techniques, eg, using a model inherent to the ProteOn XPR36™ analysis software.

In an example, the ligand of the invention is contained in a medical container, eg, a vial, syringe, IV container or an injection device (eg, an intraocular or intravitreal injection device). In an example, the ligand is in vitro, eg, in a sterile container. In an example, the invention provides a kit comprising the ligand of the invention, packaging and instructions for use in treating or preventing or diagnosing in a human a disease or condition mediated by the TOI. In an example, the instructions indicate that the human should be genotyped for a TOI variant sequence of the invention before administering the ligand to the human. In an example, the instructions indicate that the human should be phenotyped for a TOI variant of the invention before administering the ligand to the human. In an example, the human is of Chinese (eg, Han) ethnicity and the instructions are in Chinese (eg, Mandarin). In an example, the instructions comprise directions to administer alirocumab or evolocumab to said human.

The invention relates to the concepts set out in the following clauses.

Clause 1 A method of treating or preventing a disease or condition in a human, wherein the disease or condition is mediated by a Target of Interest (TOI), wherein the TOI is present in humans as different polymorphic variants, the method comprising
 a. Administering to the human an anti-TOI ligand to target a TOI variant in the human and treat or prevent (eg, by at least 40, 50, 60, 70, 80, 90 or 95%) said disease or condition, wherein the TOI in said human is encoded by a nucleotide sequence having a cumulative human allele frequency of less than 50% and/or wherein the TOI in said human is encoded by a nucleotide sequence having a total human genotype frequency of less than 50%; wherein
  Before step (a) said human has been or is genotyped as positive for said nucleotide sequence or phenotyped as positive for said TOI variant, or the method comprises before step (a) genotyping the human as positive for said nucleotide sequence or phenotyping the human as positive for said TOI variant.

In any aspect, configuration, example, embodiment, clause or concept herein, frequencies may be determined using bioinformatics.

In any aspect, configuration, example, embodiment, clause or concept herein, frequencies may be determined by reference to a database comprising at least 1000 or 2000 human sequences.

In any aspect, configuration, example, embodiment, clause or concept herein "heterozygous human genotype frequency" means the cumulative frequency of all genotypes in the sample or database or in humans having one occurrence of the rare variant allele and one occurrence of another allele (heterozygous state), eg, genotype in 1000 Genomes database.

In any aspect, configuration, example, embodiment, clause or concept herein "homozygous human genotype frequency" means the cumulative frequency of two occurrences of the variant allele (homozygous state), eg, genotype in 1000 Genomes Project database.

In any aspect, configuration, example, embodiment, clause or concept herein "total human genotype frequency" means the total of heterozygous plus homozygous human genotype frequencies.

In any aspect, configuration, example, embodiment, clause or concept herein "cumulative human allele frequency" refers to the total of all occurrences of the variant allele (eg, SNP) in the sample or database or in humans, eg, in the 1000 Genomes Project database.

Clause 2: The method of clause 1, wherein before step (a) the ligand has been or is determined as being capable of binding to said TOI variant, eg, with an affinity (Kd) disclosed below.

In an example, the ligand is (or has been determined as) a neutraliser of the TOI. In an example, determination is carried out in a human (eg, in a clinical trial). In an example, determination is carried out in a non-human, eg, in a mouse, rat, rabbit, pig, dog, sheep or non-human primate (eg, Cynomolgous monkey, rhesus monkey or baboon).

Clause 3: A method of treating or preventing a disease or condition in a human, wherein the disease or condition is mediated by a Target of Interest (TOI), wherein the TOI is present in humans as different polymorphic variants, the method comprising
 a. Administering to the human an anti-TOI ligand to target a TOI variant in the human and treat or prevent (eg, by at least 40, 50, 60, 70, 80, 90 or 95%) said disease or condition, wherein the TOI in said human is encoded by a nucleotide sequence having a cumulative human allele frequency of less than 50% and/or wherein the TOI in said human is encoded by a nucleotide sequence having a total human genotype frequency of less than 50%; wherein
 b. Before step (a) the ligand has been or is determined as capable of binding to said TOI variant, eg, with an affinity (Kd) disclosed below.

In an example, the ligand is (or has been determined as) a neutraliser of the TOI. In an example, determination is carried out in a human (eg, in a clinical trial). In an example, determination is carried out in a non-human, eg, in a mouse, rat, rabbit, pig, dog, sheep or non-human primate (eg, Cynomolgous monkey, rhesus monkey or baboon).

Clause 4: The method of clause 3, wherein the genome of said human comprises a nucleotide sequence encoding said TOI variant; and before step (a) said nucleotide sequence has been or is determined as having a cumulative human allele frequency of less than 50% and/or having a total human genotype frequency of less than 50%.

The TOI variant is not the most frequent.

Clause 5: The method of clause 3 or 4, wherein said human has been or is genotyped as positive for said variant nucleotide sequence before step (a), or the method comprises genotyping the human as positive for said variant nucleotide sequence before step (a).

Clause 6: The method of any preceding clause, wherein the human has been or is phenotyped as positive for said TOI variant before step (a), or the method comprises phenotyping the human as positive for said variant nucleotide sequence before step (a).

Clause 7: The method of any preceding clause, wherein said frequency is less than 10 or 15% (eg, from 1 to 10%).

In an embodiment, the cumulative human allele frequency is 30, 25, 20, 15, 10 or 5% or less, eg, in the range from 1 to 20% or 1 to 15% or 1 to 10%.

In an embodiment, the total human genotype frequency is 35, 30, 25, 20, 15, 10 or 5% or less, eg, in the range from 1 to 25%, 1 to 20%, 1 to 15%, 1 to about 15%, 1 to 10%, 1 to about 10% or 1 to 5% or 1 to about 5%.

Clause 8: The method of any preceding clause, wherein the ligand is capable of binding to two or more different TOI variants, each being encoded by a nucleotide sequence having a cumulative human allele frequency of less than 50% (eg, from 1 to 10%) and/or having a total human genotype frequency of less than 50% (eg, from 1 to 20%).

In an embodiment, the cumulative human allele frequency of each TOI variant is 30, 25, 20, 15, 10 or 5% or less, eg, in the range from 1 to 20% or 1 to 15% or 1 to 10%.

In an embodiment, the total human genotype frequency of each TOI variant is 35, 30, 25, 20, 15, 10 or 5% or less, eg, in the range from 1 to 25%, 1 to 20%, 1 to 15%, 1 to about 15%, 1 to 10%, 1 to about 10% or 1 to 5% or 1 to about 5%.

Clause 9: A method of treating or preventing a disease or condition in a human, wherein the disease or condition is mediated by a Target of Interest (TOI), wherein the TOI is present in humans as different polymorphic variants, the method comprising
  a. Administering to the human an anti-TOI ligand to target a TOI variant in the human and treat or prevent (eg, by at least 40, 50, 60, 70, 80, 90 or 95%) said disease or condition, wherein the TOI in said human is a variant encoded by a nucleotide sequence having a cumulative human allele frequency of more than 50% (eg, the highest frequency) and/or having a total human genotype frequency of more than 50% (eg, the highest frequency); wherein
  b. Before step (a) said human has been or is genotyped as negative for a variant nucleotide sequence having a cumulative human allele frequency of less than 50% and/or having a total human genotype frequency of less than 50%; or phenotyped as negative for a TOI variant encoded by a nucleotide sequence having a cumulative human allele frequency of less than 50% and/or having a total human genotype frequency of less than 50%; or
    Before step (a) said the method comprises genotyping the human as negative for a variant nucleotide sequence having a cumulative human allele frequency of less than 50% and/or having a total human genotype frequency of less than 50%; or phenotyping the human as negative for a TOI variant encoded by a nucleotide sequence having a cumulative human allele frequency of less than 50% and/or having a total human genotype frequency of less than 50%.

In an embodiment, in (a) the cumulative human allele frequency is 55, 60, 65, 70, 75, 80, 85 or 90 or more but less than 95, 96, 97, 98, 99 or 100% (eg, in the range from 51 to 80%).

In an embodiment, in (a) the total human genotype frequency is 55, 60, 65, 70, 75, 80, 85 or 90 or more but less than 95, 96, 97, 98, 99 or 100% (eg, in the range from 51 to 80%).

In an embodiment, in (b) the cumulative human allele frequency is 30, 25, 20, 15, 10 or 5% or less, eg, in the range from 1 to 20% or 1 to 15% or 1 to 10%.

In an embodiment, in (b) the total human genotype frequency is 35, 30, 25, 20, 15, 10 or 5% or less, eg, in the range from 1 to 25%, 1 to 20%, 1 to 15%, 1 to about 15%, 1 to 10%, 1 to about 10% or 1 to 5% or 1 to about 5%.

Clause 10: The method of clause 9, wherein before step (a), the human has been or is phenotyped as positive for the most frequent TOI variant or genotyped for the nucleotide sequence thereof.

In an embodiment, before step (a) the human has been or is genotyped as positive for TOI variant nucleotide sequence having a cumulative human allele frequency of 55, 60, 65, 70, 75, 80, 85 or 90 or more but less than 95, 96, 97, 98, 99 or 100% (eg, in the range from 51 to 80%) or phenotyped for the TOI variant thereof.

In an embodiment, before step (a) the human has been or is genotyped as positive for TOI variant nucleotide sequence having a total human genotype frequency of 55, 60, 65, 70, 75, 80, 85 or 90 or more but less than 95, 96, 97, 98, 99 or 100% (eg, in the range from 51 to 80%) or phenotyped for the TOI variant thereof.

Clause 11: The method of clause 9 or 10, wherein before step (a) the ligand has been or is determined as being capable of binding to the most frequent TOI variant.

Clause 12: The method of clause 9, 10 or 11, wherein before step (a) the ligand has been or is determined as being substantially incapable of neutralising or inhibiting said TOI variant recited in step (b).

By "substantially incapable or neutralising or inhibiting" is meant: Neutralisation or inhibition less than 50, 25, 10, 5 or 0.5% inhibition or neutralisation of the most frequent TOI variant.

Clause 13: The method of any one of clauses 9 to 12, wherein the ligand is capable of binding to the most frequent TOI variant.

Clause 14: The method of any one of clauses 9 to 13, wherein the ligand is capable of binding to two or more different TOI variants, each being encoded by a nucleotide sequence having a cumulative human allele frequency of more than 50%.

In an embodiment, each TOI variant is encoded by a nucleotide sequence having a cumulative human allele frequency of 55, 60, 65, 70, 75, 80, 85 or 90 or more but less than 95, 96, 97, 98, 99 or 100% (eg, in the range from 51 to 80%).

In an embodiment, each TOI variant is encoded by a nucleotide sequence having a total human genotype frequency of 55, 60, 65, 70, 75, 80, 85 or 90 or more but less than 95, 96, 97, 98, 99 or 100% (eg, in the range from 51 to 80%).

Clause 15: The method of any preceding clause, wherein said variant nucleotide sequence recited in step (a) has been or is determined as being present in at least 2 different human ethnic populations, eg, at least 2, 3, 4, 5, 6, 7, 8 or 9 different human ethnic populations in Table 4.

Clause 16: The method of any preceding clause, wherein said human frequency is the frequency in a database of naturally-occurring sequences sampled from at least 15, 20 or 25 different human ethnic populations and comprising at least 1000 sequences. In an embodiment, the database is the 1000 Genomes Project database as described herein.

Clause 17: An anti-human TOI ligand for use in a method of treating and/or preventing a TOI-mediated disease or condition in a human, wherein the TOI is present in humans as different polymorphic variants and wherein the genome of said human comprises a TOI nucleotide sequence having a cumulative human allele frequency of less than 50% and/or a total human genotype frequency of less than 50%, the method comprising administering the ligand to the human.

In the alternative, clause 17 provides an anti-human TOI ligand for use in a method according to any one of clauses 1 to 16, the method comprising administering the ligand to the human.

In an embodiment, the cumulative human allele frequency is 30, 25, 20, 15, 10 or 5% or less, eg, in the range from 1 to 20% or 1 to 15% or 1 to 10%.

In an embodiment, the total human genotype frequency is 35, 30, 25, 20, 15, 10 or 5% or less, eg, in the range from 1 to 25%, 1 to 20%, 1 to 15%, 1 to about 15%, 1 to 10%, 1 to about 10% or 1 to 5% or 1 to about 5%.

Clause 18: The ligand of clause 17, wherein the ligand has been or is determined as capable of binding the human TOI encoded by said nucleotide sequence.

In the alternative, clause 18 provides a ligand that binds a human TOI comprising an amino acid sequence encoded by a TOI nucleotide sequence having a cumulative human allele frequency of less than 50% and/or a total human genotype frequency of less than 50%, for use in a method comprising the step of using the ligand to target said TOI in a human to treat and/or prevent a disease or condition mediated by TOI, the method comprising administering the ligand to the human.

Clause 19: A ligand that binds a human TOI comprising an amino acid sequence encoded by a TOI nucleotide sequence having a cumulative human allele frequency of less than 50% and/or a total human genotype frequency of less than 50%, for use in a method according to any one of clauses 1 to 16, the method comprising administering the ligand to the human.

Clause 20: The ligand of any one of clauses 17 to 19, wherein the human has been or is genotyped as positive for said TOI nucleotide sequence having a cumulative human allele frequency of less than 50%.

The ligand of any one of clauses 17 to 19, wherein the human has been or is genotyped as positive for said TOI nucleotide sequence having a total human genotype frequency of less than 50%.

Clause 21: The ligand of any one of clauses 17 to 20, wherein the human has been or is phenotyped as positive for a TOI encoded by a nucleotide sequence having a cumulative human allele frequency of less than 50% and/or having a total human genotype frequency of less than 50%.

Clause 22: The ligand of any one of clauses 17 to 21, wherein the human has been or is genotyped as heterozygous for a TOI nucleotide sequence having a cumulative human allele frequency of less than 50% and/or having a total human genotype frequency of less than 50%; optionally wherein the human has been or is genotyped as comprising a TOI nucleotide sequence having a cumulative human allele frequency of less than 50% and a TOI nucleotide sequence having a cumulative human allele frequency of more than 50% (eg, having the highest cumulative human allele frequency) and/or having a total human genotype frequency of more than 50% (eg, having the highest total human genotype frequency).

Clause 23: The ligand of any one of clauses 17 to 22, wherein the genome of the human has been or is genotyped as homozygous for a TOI nucleotide sequence having a cumulative human allele frequency of less than 50% and/or having a total human genotype frequency of less than 50%.

Clause 24: The ligand of any one of clauses 17 to 23, wherein the ligand comprises an antibody binding site that binds a human TOI comprising an amino acid sequence encoded by a TOI nucleotide sequence having a cumulative human allele frequency of less than 50% and/or having a total human genotype frequency of less than 50%; and optionally has been or is determined as capable of such binding.

Clause 25: The ligand of clause 24, wherein the ligand is an antibody or antibody fragment.

Clause 26: The ligand of any one of clauses 17 to 23, wherein the ligand comprises a nucleotide sequence that specifically hybridises to a TOI nucleotide sequence having a cumulative human allele frequency of less than 50% and/or having a total human genotype frequency of less than 50% or an RNA transcript thereof; and/or the ligand comprises a nucleotide sequence that comprises at least 10 contiguous nucleotides of a nucleotide sequence having a cumulative human allele frequency of less than 50% and/or having a total human genotype frequency of less than 50% or is an antisense sequence thereof.

In an embodiment, the ligand comprises a nucleotide sequence that comprises at least 10, 11, 12, 13, 14, 15, 20, 25, 30, 35, 40, 45, 50 or 100 contiguous nucleotides of a nucleotide sequence having a cumulative human allele frequency of less than 50% and/or having a total human genotype frequency of less than 50% or is an antisense sequence thereof.

Clause 27: The ligand of any one of clauses 17 to 26, wherein the genome of said human comprises a nucleotide sequence having a cumulative human allele frequency of less than 50% and the sequence is found in at least 2 different ethnic populations (eg, found in at least 9, 10, 11, 12, 13, 14, 15, 16, 17, 18, 19 or 20 different human ethnic populations (for example as per the populations in Table 4)). In an example, numbers are with reference to the 1000 Genomes Project database.

The ligand of any one of clauses 17 to 26, wherein the genome of said human comprises a nucleotide sequence having a cumulative human allele frequency of less than 50% and the sequence is found in at least 20 individuals distributed across at least 2 said different ethnic populations (eg, found in at least in at least 20, 25, 30, 35, 40, 45, 50, 55, 60, 65, 70, 75, 80, 85, 90, 95, 100, 105, 110, 115, 120, 130, 140 or 150 individuals distributed across such many different ethnic populations). In an example, numbers are with reference to the 1000 Genomes Project database.

Clause 28: A pharmaceutical composition or kit for treating or preventing a condition or disease mediated by a TOI as recited in any preceding clause, the composition or kit comprising a ligand of any one of clauses 17 to 27; and optionally in combination with a label or instructions for use to treat and/or prevent said disease or condition in a human; optionally wherein the label or instructions comprise a marketing authorisation number (eg, an FDA or EMA authorisation number); optionally wherein the kit comprises an injection pen or IV container that comprises the ligand.

In an example, the label or instructions cover or describe use for a human comprising a TOI variant encoded by a nucleotide sequence as recited in clause 17.

Clause 29: A method of producing an anti-human TOI antibody binding site, the method comprising obtaining a plurality of anti-TOI antibody binding sites, screening the antibody binding sites for binding to a TOI comprising an amino acid sequence encoded by a nucleotide sequence having a cumulative human allele frequency of less than 50% and/or a total human genotype frequency of less than 50%, or to a peptide thereof that comprises an amino acid variation from the corresponding sequence encoded by the TOI-encoding nucleotide sequence having the highest cumulative human allele frequency and/or the highest total human genotype frequency, and isolating an antibody binding site that binds in the screening step.

In an embodiment of any aspect herein, the antibody, fragment or binding site is recombinant.

In the alternative, clause 29 provides: A method of producing an anti-human TOI antibody, the method comprising immunising a non-human vertebrate (eg, a mouse or a rat) with a TOI comprising an amino acid sequence encoded by a nucleotide sequence having a cumulative human allele frequency of less than 50% and/or a total human genotype frequency of less than 50%, or to a peptide thereof that comprises an amino acid variation from the corresponding sequence encoded by the TOI-encoding nucleotide sequence having the highest cumulative human allele frequency and/or the highest total human genotype frequency, and isolating an antibody that binds a TOI comprising an amino acid sequence encoded by a TOI nucleotide sequence having a cumulative human allele frequency of less than 50% and/or a total human genotype frequency of less than 50%, and optionally producing a TOI-binding fragment or derivative of the isolated antibody.

The term "isolated" with reference to a ligand, antibody or protein, for example in any aspect, configuration, example or embodiment, means that a subject ligand, antibody, protein etc (1) is free of at least some other proteins with which it would normally be found, (2) is essentially free of other proteins from the same source, e.g., from the same species, (3) is expressed by a cell from a different species, (4) has been separated from at least about 50 percent of polynucleotides, lipids, carbohydrates, or other materials with which it is associated in nature, (5) is operably associated (by covalent or noncovalent interaction) with a polypeptide with which it is not associated in nature, or (6) does not occur in nature. Typically, an "isolated" ligand, antibody, protein etc constitutes at least about 5%, at least about 10%, at least about 25%, or at least about 50% of a given sample. Genomic DNA, cDNA, mRNA or other RNA, of synthetic origin, or any combination thereof can encode such an isolated ligand, antibody protein etc. Preferably, the isolated ligand, antibody protein etc is substantially free from proteins or polypeptides or other contaminants that are found in its natural environment that would interfere with its therapeutic, diagnostic, prophylactic, research or other use.

For example, an "isolated" antibody is one that has been identified, separated and/or recovered from a component of its production environment (eg, naturally or recombinantly). Preferably, the isolated polypeptide is free of association with all other components from its production environment, eg, so that the antibody has been isolated to an FDA-approvable or approved standard. Contaminant components of its production environment, such as that resulting from recombinant transfected cells, are materials that would typically interfere with research, diagnostic or therapeutic uses for the antibody, and may include enzymes, hormones, and other proteinaceous or non-proteinaceous solutes. In preferred embodiments, the polypeptide will be purified: (1) to greater than 95% by weight of antibody as determined by, for example, the Lowry method, and in some embodiments, to greater than 99% by weight; (2) to a degree sufficient to obtain at least 15 residues of N-terminal or internal amino acid sequence by use of a spinning cup sequenator, or (3) to homogeneity by SDS-PAGE under non-reducing or reducing conditions using Coomassie blue or, preferably, silver stain. Isolated antibody includes the antibody in situ within recombinant cells since at least one component of the antibody's natural environment will not be present. Ordinarily, however, an isolated polypeptide or antibody will be prepared by at least one purification step.

Immunoconjugates

The invention encompasses the ligand (eg, antibody) conjugated to a therapeutic moiety ("immunoconjugate"), such as a cytotoxin, a chemotherapeutic drug, an immunosuppressant or a radioisotope. Cytotoxin agents include any agent that is detrimental to cells. Examples of suitable cytotoxin agents and chemotherapeutic agents for forming immunoconjugates are known in the art, see for example, WO 05/103081.

Bispecifics

The antibodies of the present invention may be monospecific, bispecific, or multispecific. Multispecific mAbs may be specific for different epitopes of one target polypeptide or may contain antigen-binding domains specific for more than one target polypeptide. See, e.g., Tutt et al. (1991) J. Immunol 147:60-69. The human anti-TOI (eg, anti-PCSK9) mAbs can be linked to or co-expressed with another functional molecule, e.g., another peptide or protein. For example, an antibody or fragment thereof can be functionally linked (e.g., by chemical coupling, genetic fusion, noncovalent association or otherwise) to one or more other molecular entities, such as another antibody or antibody fragment, to produce a bispecific or a multispecific antibody with a second binding specificity.

An exemplary bi-specific antibody format that can be used in the context of the present invention involves the use of a first immunoglobulin (Ig) CH3 domain and a second Ig CH3 domain, wherein the first and second Ig CH3 domains differ from one another by at least one amino acid, and wherein at least one amino acid difference reduces binding of the bispecific antibody to Protein A as compared to a bi-specific antibody lacking the amino acid difference. In one embodiment, the first Ig CH3 domain binds Protein A and the second Ig CH3 domain contains a mutation that reduces or abolishes Protein A binding such as an H95R modification (by IMGT exon numbering; H435R by EU numbering). The second CH3 may further comprise a Y96F modification (by IMGT; Y436F by EU). Further modifications that may be found within the second CH3 include: D16E, L18M, N44S, K52N, V57M, and V82I (by IMGT; D356E, L358M, N384S, K392N, V397M, and V422I by EU) in the case of IgG1 antibodies; N44S, K52N, and V82I (IMGT; N384S, K392N, and V422I by EU) in the case of IgG2 antibodies; and Q15R, N44S, K52N, V57M, R69K, E79Q, and V82I (by IMGT; Q355R, N3845, K392N, V397M, R409K, E419Q, and V422I by EU) in the case of IgG4 antibodies. Variations on the bi-specific antibody format described above are contemplated within the scope of the present invention.

Clause 30: The method of clause 29, comprising the step of obtaining a nucleic acid encoding the antibody, fragment, derivative or binding site and optionally inserting the nucleic acid in an expression vector.

Clause 31: A kit for TOI genotyping a human, wherein the kit comprises a nucleic acid comprising a nucleotide sequence that specifically hybridises to a TOI nucleotide sequence selected having a cumulative human allele frequency of less than 50% and/or a total human genotype frequency of less than 50% or an RNA transcript thereof; and/or the nucleic acid comprises a nucleotide sequence that comprises at least 10 (eg, at least 10, 11, 12, 13, 14, 15, 20, 25, 30, 35, 40, 45, 50 or 100) contiguous nucleotides of a TOI nucleotide sequence having a cumulative human allele frequency of less than 50% and/or a total human genotype frequency of less than 50% or is an antisense sequence thereof.

For example, the nucleic acid hybridises to a region immediately flanking a nucleotide that is variant compared to the corresponding nucleotide of the TOI nucleotide sequence having the highest cumulative human allele frequency and/or the highest total human genotype frequency. In an example, the nucleic acid hybridises to at two or more such variant nucleotides.

Specific hybridisation is under stringent conditions, as will be apparent to the skilled person, eg, conditions of 5×SSC, 5×Denhardt's reagent, and 0.5% SDS at 65° C.

Clause 32: A kit for TOI genotyping or phenotyping a human, wherein the kit comprises a ligand according to any one of clauses 17 to 27 or an antibody, fragment or derivative produced by the method of any one of clauses 29 to 31.

For example, the ligand specifically binds to an epitope comprising an amino acid that is variant compared to the corresponding amino acid of the TOI encoded by a nucleotide sequence having the highest cumulative human allele frequency and/or the highest total human genotype frequency. In an example, the ligand specifically binds to an epitope comprising two or more such variant amino acids. In an example, specific binding means binding with an affinity (Kd) of 1 mM, 100 nM, 10 nM or 1 nM or less, eg, as determined by SPR.

The term "epitope" is a region of an antigen that is bound by an antibody. Epitopes may be defined as structural or functional. Functional epitopes are generally a subset of the structural epitopes and have those residues that directly contribute to the affinity of the interaction. Epitopes may also be conformational, that is, composed of non-linear amino acids. In certain embodiments, epitopes may include determinants that are chemically active surface groupings of molecules such as amino acids, sugar side chains, phosphoryl groups, or sulfonyl groups, and, in certain embodiments, may have specific three-dimensional structural characteristics, and/or specific charge characteristics.

Clause 33: Use of an anti-TOI ligand that binds a human TOI comprising an amino acid sequence encoded by a TOI nucleotide sequence having a cumulative human allele frequency of less than 50% and/or a total human genotype frequency of less than 50%, in the manufacture of a medicament for treating and/or preventing a TOI-mediated disease or condition in a human whose genome comprises a TOI nucleotide sequence having a cumulative human allele frequency of less than 50% and/or having a total human genotype frequency of less than 50%.

Clause 34: Use of an anti-TOI ligand that binds a human TOI comprising an amino acid sequence encoded by a TOI nucleotide sequence having a cumulative human allele frequency of less than 50% and/or a total human genotype frequency of less than 50%, in the manufacture of a medicament for targeting said TOI in a human to treat and/or prevent a disease or condition mediated by TOI.

The use of clause 33 or 34, wherein the ligand, human, disease or condition is according to any one of clauses 1 to 27.

Clause 35: A method of targeting a TOI for treating and/or preventing a TOI-mediated disease or condition in a human, the method comprising administering an anti-TOI ligand to a human comprising a TOI nucleotide sequence selected having a cumulative human allele frequency of less than 50% and/or a total human genotype frequency of less than 50%, whereby a TOI encoded by said nucleotide sequence is targeted.

Clause 36: The method of clause 35, wherein the method comprises targeting a human TOI comprising an amino acid sequence with said ligand to treat and/or prevent said disease or condition in said human, wherein said amino acid sequence is encoded by a nucleotide sequence having a cumulative human allele frequency of less than 50% and/or a total human genotype frequency of less than 50%.

Clause 37: A method of TOI genotyping a nucleic acid sample of a human, the method comprising identifying in the sample the presence of a TOI nucleotide sequence having a cumulative human allele frequency of less than 50% and/or having a total human genotype frequency of less than 50%.

In an example, the method comprises obtaining a TOI nucleic acid sample from the human and then carrying out the identifying step.

Clause 38: A method of TOI typing a protein sample of a human, the method comprising identifying in the sample the presence of a TOI amino acid sequence encoded by a TOI nucleotide sequence having a cumulative human allele frequency of less than 50% and/or having a total human genotype frequency of less than 50%.

In an example, the method comprises obtaining a TOI protein sample from the human and then carrying out the identifying step.

Clause 39: The method of clause 37 or 38, comprising obtaining a sample of serum, blood, feces, hair, urine or saliva from a human, whereby the nucleic acid or protein sample is obtained for use in the step of identifying said sequence.

Clause 40: The method of any one of clauses 37 to 39, comprising using a ligand according to any one of clauses 17 to 27 to carry out said identifying step.

Clause 41: A diagnostic kit comprising a ligand that is capable of binding a human TOI comprising an amino acid sequence encoded by a TOI nucleotide sequence having a cumulative human allele frequency of less than 50% and/or a total human genotype frequency of less than 50% and instructions for carrying out the method of clause 38 or 39.

Clause 42: A diagnostic kit comprising a nucleic acid probe comprising a nucleotide sequence that specifically hybridises a TOI nucleotide sequence having a cumulative human allele frequency of less than 50% and/or a total human genotype frequency of less than 50% or an RNA transcript thereof and instructions for carrying out the method of clause 38 or 39.

Clause 43: The method, ligand, composition, kit or use of any preceding clause, wherein the TOI is encoded by a nucleotide sequence having a cumulative human allele frequency from 1 to 10% and/or a total human genotype frequency from 1 to about 15% or from 1 to 15%.

Clause 44: The method, ligand, composition, kit or use of any preceding clause wherein the TOI is a human TOI selected from Table 5; optionally for treating and/or preventing a corresponding disease or condition as set out in Table 5.

For example, the TOI is human PCSK9, eg, a mature, cleaved, autocatalysed or active PCSK9. In an example, the disease is a cardiovascular disease such as hyperlipidaemia.

Ligands of the invention are useful, for instance, in specific binding assays, for genotyping or phenotyping humans, affinity purification of the TOI and in screening assays to identify other antagonists of TOI activity. Some of the ligands of the invention are useful for inhibiting binding of TOI to a cognate human receptor or protein, or inhibiting TOI-mediated activities.

The invention encompasses anti-TOI (eg, PCSK9) antibody ligands having a modified glycosylation pattern. In some applications, modification to remove undesirable glycosylation sites may be useful, or e.g., removal of a fucose moiety to increase antibody dependent cellular cytotoxicity (ADCC) function (see Shield et al. (2002) JBC 277:26733). In other applications, modification of galactosylation can be made in order to modify complement dependent cytotoxicity (CDC).

In an example, the invention features a pharmaceutical composition comprising a ligand of the invention, wherein the ligand is or comprises a recombinant human antibody or fragment thereof which specifically binds the TOI (eg, a rare variant as described herein) and a pharmaceutically acceptable carrier. In one embodiment, the invention features a composition which is a combination of an antibody ligand or antigen-binding fragment of an antibody of the invention, and a second therapeutic agent. The second therapeutic agent may be any of an anti-inflammatory agent, an anti-angiogenesis agent, a painkiller, a diuretic, a chemotherapeutic agent, an anti-neoplastic agent, a vasodilator, a vasoconstrictor, a statin, a beta blocker, a nutrient, an adjuvant, an anti-obesity agent and an anti-diabetes agent.

"Pharmaceutically acceptable" refers to approved or approvable by a regulatory agency of the USA Federal or a state government or listed in the U.S. Pharmacopeia or other generally recognized pharmacopeia for use in animals, including humans. A "pharmaceutically acceptable carrier, excipient, or adjuvant" refers to an carrier, excipient, or adjuvant that can be administered to a subject, together with an agent, e.g., any antibody or antibody chain described herein, and which does not destroy the pharmacological activity thereof and is nontoxic when administered in doses sufficient to deliver a therapeutic amount of the agent.

In an example, the invention features a method for inhibiting TOI activity using the anti-TOI ligand of the invention (eg, an antibody or antigen-binding portion of the antibody of the invention), wherein the therapeutic method comprises administering a therapeutically effective amount of a pharmaceutical composition comprising the ligand. The disorder treated is any disease or condition which is improved, ameliorated, inhibited or prevented by removal, inhibition or reduction of TOI activity.

By the phrase "therapeutically effective amount" is meant an amount that produces the desired effect for which it is administered. The exact amount will depend on the purpose of the treatment, and will be ascertainable by one skilled in the art using known techniques (see, for example, Lloyd (1999) The Art, Science and Technology of Pharmaceutical Compounding).

The term "specifically binds," or the like, means that a ligand, eg, an antibody or antigen-binding fragment thereof, forms a complex with an antigen that is relatively stable under physiologic conditions. Specific binding can be characterized by an equilibrium dissociation constant of at least about $1\times10^{-6}$M or less (e.g., a smaller KD denotes a tighter binding). Methods for determining whether two molecules specifically bind are well known in the art and include, for example, equilibrium dialysis, surface plasmon resonance, and the like. An isolated antibody that specifically binds a human TOI may, however, exhibit cross-reactivity to other antigens such as a TOI molecule from another species. Moreover, multi-specific antibodies (e.g., bispecifics) that bind to human TOI and one or more additional antigens are nonetheless considered antibodies that "specifically bind" TOI, as used herein.

Genotyping & Phenotyping

The skilled person will be familiar with techniques that can be used for accurate genotyping and application to the invention. These include the following.
1 Hybridization-based methods
1.1 Dynamic allele-specific hybridization
1.2 Molecular beacons
1.3 SNP microarrays
2 Enzyme-based methods
2.1 Restriction fragment length polymorphism
2.2 PCR-based methods
2.3 Flap endonuclease
2.4 Primer extension
2.5 5'-nuclease
2.6 Oligonucleotide Ligation Assay
3 Other post-amplification methods based on physical properties of DNA
3.1 Single strand conformation polymorphism
3.2 Temperature gradient gel electrophoresis
3.3 Denaturing high performance liquid chromatography
3.4 High-resolution melting of the entire amplicon
3.5 Use of DNA mismatch-binding proteins
3.6 SNPlex (SNPlex™ is a proprietary genotyping platform sold by Applied Biosystems).

Next-generation sequencing technologies such as pyrosequencing is also useful.

Reference is also made to GB2444410A and the genotyping method disclosed therein, which is incorporated herein by reference in its entirety.

Miniaturized assays, such as microarrays with oligonucleotide reagents immobilized on small surfaces, are frequently proposed for large-scale mutation analysis and high-throughput genotyping (Large-scale identification, mapping, and genotyping of single-nucleotide polymorphisms in the human genome (Wang D G, Fan J B, Siao C J, Berno A, Young P, Sapolsky R, Ghandour G, Perkins N, Winchester E, Spencer J, Kruglyak L, Stein L, Hsie L, Topaloglou T, Hubbell E, Robinson E, Mittmann M, Morris M S, Shen N, Kilburn D, Rioux J, Nusbaum C, Rozen S, Hudson T J, Lipshutz R, Chee M, Lander E S, Science. 1998 May 15; 280(5366):1077-82). Other high-throughput methods discriminate alleles by differential hybridization, primer extension, ligation and cleavage of an allele-specific probe (Review Accessing genetic variation: genotyping single nucleotide polymorphisms, Syvänen AC, Nat Rev Genet. 2001 December; 2(12):930-42; Review Techniques patents for SNP genotyping, Twyman R M, Primrose S B, Pharmacogenomics. 2003 January; 4(1): 67-79).

An approach for a fully automated, large-scale SNP analysis is the 'homogeneous' assay, i.e. a single-phase assay without separation steps, permitting continual monitoring during amplification. The TaqMan™ assay (Applied Biosystems), originally designed for quantitative real-time PCR, is a homogeneous, single-step assay also used in determination of mutation status of DNA (see, eg, A. A. Komar (ed.), Single Nucleotide Polymorphisms, Methods in Molecular Biology 578, DOI 10.1007/978-1-60327-411-1_19, Humana Press, a part of Springer Science+Business Media, LLC; and Single Nucleotide Polymorphisms, Methods in Molecular Biology™ Volume 578, 2009, pp 293-306, The TaqMan Method for SNP Genotyping, Gong-Qing Shen et al). The TaqMan SNP Genotyping Assay exploits the 5'-exonuclease activity of AmpliTaq Gold™ DNA polymerase to cleave a doubly labeled probe hybridized to the SNP-containing sequence of ssDNA. Cleavage separates a 5'-fluorophore from a 3'-quencher leading to detectable fluorescent signal. The use of two allele-specific probes carrying different fluorophores permits SNP determination in the same tube without any post-PCR processing. Genotype is determined from the ratio of intensities of the two fluorescent probes at the end of amplification. Thus, rather than taking advantage of the full set of real-time PCR data as in quantitative studies, only end-point data are used.

TaqMan SNP genotyping in a high-throughput, automated manner is facilitated by the use of validated Pre-made TaqMan® Genotyping assays, but Custom TaqMan® Assays may also be used (High-throughput genotyping with single nucleotide polymorphisms, Ranade K, Chang M S, Ting C T, Pei D, Hsiao C F, Olivier M, Pesich R, Hebert J, Chen Y D, Dzau V J, Curb D, Olshen R, Risch N, Cox D R, Botstein D, Genome Res. 2001 July; 11(7):1262-8; Assessment of two flexible and compatible SNP genotyping platforms: TaqMan SNP Genotyping Assays and the SNPlex Genotyping System, De la Vega F M, Lazaruk K D, Rhodes M D, Wenz M H, Mutat Res. 2005 Jun. 3; 573(1-2):111-35). The results of the assay can be automatically determined by genotyping software provided with real-time thermal cyclers (e.g. IQ software of Bio-Rad, Sequence Detection Software of Applied Biosystems).

Single nucleotide polymorphisms (SNPs) can be determined using TaqMan™ real-time PCR assays (Applied Biosystems) and commercial software that assigns genotypes based on reporter probe signals at the end of amplification. An algorithm for automatic genotype caling of SNPs using the full course of TaqMan real-time data is available for use (A. Callegaro et al, Nucleic Acids Res. 2006; 34(7): e56, Published online 2006 April 14. doi: 10.1093/nar/gkl185, PMCID: PMC1440877). The algorithm is unique in that it classifies samples according to the behavior of blanks (no DNA samples), which cluster with heterozygous samples. This method of classification eliminates the need for positive controls and permits accurate genotyping even in the absence of a genotype class, for example when one allele is rare.

The skilled person will be familiar with techniques that can be used for accurate phenotyping and application to the invention. These include the use of amino acid sequencing of isolated target protein and comparison of sequences from different variants (eg, with the most common variant). An antibody that specifically and selectively binds in the area of a SNP under stringent conditions can also be used to identify a particular variant. In another method, the genotype is determined and a corresponding amino acid sequence (phenotype) determined, eg, by in silico translation.

Therapeutic Administration and Formulations

The invention provides therapeutic compositions comprising the anti-TOI ligand, eg, antibodies or antigen-binding fragments thereof, of the present invention. The administration of therapeutic compositions in accordance with the invention will be administered with suitable carriers, excipients, and other agents that are incorporated into formulations to provide improved transfer, delivery, tolerance, and the like. A multitude of appropriate formulations can be found in the formulary known to all pharmaceutical chemists: Remington's Pharmaceutical Sciences, Mack Publishing Company, Easton, Pa. These formulations include, for example, powders, pastes, ointments, jellies, waxes, oils, lipids, lipid (cationic or anionic) containing vesicles (such as LIPOFECTINT™), DNA conjugates, anhydrous absorption pastes, oil-in-water and water-in-oil emulsions, emulsions carbowax (polyethylene glycols of various molecular weights), semi-solid gels, and semi-solid mixtures containing carbowax. See also Powell et al. "Compendium of excipients for parenteral formulations" PDA (1998) J Pharm Sci Technol 52:238-311.

The dose may vary depending upon the age and the size of a subject to be administered, target disease, conditions, route of administration, and the like. When the ligand, eg, antibody, of the present invention is used for treating various conditions and diseases associated with the TOI in an adult patient, it is advantageous to intravenously administer the antibody of the present invention normally at a single dose of about 0.01 to about 20 mg/kg body weight, more preferably about 0.02 to about 7, about 0.03 to about 5, or about 0.05 to about 3 mg/kg body weight. Depending on the severity of the condition, the frequency and the duration of the treatment can be adjusted.

Various delivery systems are known and can be used to administer the ligand or pharmaceutical composition of the invention, for example a ligand provided by e.g., encapsulation in liposomes, microparticles, microcapsules, recombinant cells capable of expressing the mutant viruses, receptor mediated endocytosis (see, e.g., Wu et al. (1987) J. Biol. Chem. 262:4429-4432). Methods of introduction include, but are not limited to, intradermal, intramuscular, intraperitoneal, intravenous, subcutaneous, intranasal, epidural, and oral routes. The ligand or composition may be administered by any convenient route, for example by infusion or bolus injection, by absorption through epithelial or mucocutaneous linings (e.g., oral mucosa, rectal and intestinal mucosa, etc.) and may be administered together with other biologically active agents. Administration can be systemic or local.

The ligand or pharmaceutical composition can be also delivered in a vesicle, in particular a liposome (see Langer (1990) Science 249:1527-1533; Treat et al. (1989) in Liposomes in the Therapy of Infectious Disease and Cancer, Lopez Berestein and Fidler (eds.), Liss, New York, pp. 353-365; Lopez-Berestein, ibid., pp. 317-327; see generally ibid.).

In certain situations, the ligand or pharmaceutical composition can be delivered in a controlled release system. In one embodiment, a pump may be used (see Langer, supra; Sefton (1987) CRC Crit. Ref. Biomed. Eng. 14:201). In another embodiment, polymeric materials can be used; see, Medical Applications of Controlled Release, Langer and Wise (eds.), CRC Pres., Boca Raton, Fla. (1974). In yet another embodiment, a controlled release system can be placed in proximity of the composition's target, thus requiring only a fraction of the systemic dose (see, e.g., Goodson, in Medical Applications of Controlled Release, supra, vol. 2, pp. 115-138, 1984).

The injectable preparations may include dosage forms for intravenous, subcutaneous, intracutaneous and intramuscular injections, drip infusions, etc. These injectable preparations may be prepared by methods publicly known. For example, the injectable preparations may be prepared, e.g., by dissolving, suspending or emulsifying the antibody or its salt described above in a sterile aqueous medium or an oily medium conventionally used for injections. As the aqueous medium for injections, there are, for example, physiological saline, an isotonic solution containing glucose and other auxiliary agents, etc., which may be used in combination with an appropriate solubilizing agent such as an alcohol (e.g., ethanol), a polyalcohol (e.g., propylene glycol, polyethylene glycol), a nonionic surfactant [e.g., polysorbate 80, HCO-50 (polyoxyethylene (50 mol) adduct of hydrogenated castor oil)], etc. As the oily medium, there are employed, e.g., sesame oil, soybean oil, etc., which may be used in combination with a solubilizing agent such as benzyl benzoate, benzyl alcohol, etc. The injection thus prepared is preferably filled in an appropriate ampoule. A pharmaceutical composition of the present invention can be delivered subcutaneously or intravenously with a standard needle and syringe. In addition, with respect to subcutaneous delivery, a pen delivery device readily has applications in delivering a pharmaceutical composition of the present invention. Such a pen delivery device can be reusable or disposable. A reusable pen delivery device generally utilizes a replaceable cartridge that contains a pharmaceutical composition. Once all of the pharmaceutical composition within the cartridge has been administered and the cartridge is empty, the empty cartridge can readily be discarded and replaced with a new cartridge that contains the pharmaceutical composition. The pen delivery device can then be reused. In a disposable pen delivery device, there is no replaceable cartridge. Rather, the disposable pen delivery device comes prefilled with the pharmaceutical composition held in a reservoir within the device. Once the reservoir is emptied of the pharmaceutical composition, the entire device is discarded.

Numerous reusable pen and autoinjector delivery devices have applications in the subcutaneous delivery of a ligand or pharmaceutical composition of the present invention. Examples include, but certainly are not limited to AUTOPEN™ (Owen Mumford, Inc., Woodstock, UK), DISETRONIC™ pen (Disetronic Medical Systems, Burghdorf, Switzerland), HUMALOG MIX 75/25™ pen, HUMALOG™ pen, HUMALIN 70/30™ pen (Eli Lilly and Co., Indianapolis, Ind.), NOVOPEN™I, II and III (Novo Nordisk, Copenhagen, Denmark), NOVOPEN JUNIOR™ (Novo Nordisk, Copenhagen, Denmark), BD™ pen (Becton Dickinson, Franklin Lakes, N.J.), OPTIPENT™, OPTIPEN PRO™, OPTIPEN STARLET™, and OPTICLIKT™ (sanofi-aventis, Frankfurt, Germany), to name only a few. Examples of disposable pen delivery devices having applications in subcutaneous delivery of a pharmaceutical composition of the present invention include, but certainly are not limited to the SOLOSTAR™ pen (sanofi-aventis), the FLEXPEN™ (Novo Nordisk), and the KWIKPEN™ (Eli Lilly).

Advantageously, the pharmaceutical compositions for oral or parenteral use described above are prepared into dosage forms in a unit dose suited to fit a dose of the ligand(s). Such dosage forms in a unit dose include, for example, tablets, pills, capsules, injections (ampoules), suppositories, etc. The amount of the aforesaid antibody contained is generally about 5 to about 500 mg per dosage form in a unit dose; especially in the form of injection, it is preferred that the aforesaid antibody is contained in about 5 to about 100 mg and in about 10 to about 250 mg for the other dosage forms.

Exemplary TOIs

For example in any configuration, aspect, concept, example or configuration of the invention, the or each TOI is selected from the group consisting of ABCF1; ACVR1; ACVR1B; ACVR2; ACVR2B; ACVRL1; ADORA2A; Aggrecan; AGR2; AICDA; AW1; AIG1; AKAP1; AKAP2; AIYIH; amyloid-beta; AMHR2; ANGPT1; ANGPT2; ANGPTL3; ANGPTL4; ANPEP; APC; APOC1; AR; Ax1; AZGP1 (zinc-a-glycoprotein); B7.1; B7.2; BAD; BAFF; BAG1; BAI1; BCL2; BCL6; BDNF; BLNK; BLR1 (MDR15); B1yS; BMP1; BMP2; BMP3B (GDF1O); BMP4; BMP6; BMP8; BMPR1A; BMPR1B; BMPR2; BPAG1 (plectin); BRCA1; C19orflO (IL27w); C3; C4A; C5; C5R1; CANT1; CASP1; CASP4; CAV1; CB1; CCBP2 (D6/JAB61); CCL1 (I-309); CCL11 (eotaxin); CCL13 (MCP-4); CCL15 (MIP-id); CCL16 (HCC-4); CCL17 (TARC); CCL18 (PARC); CCL19 (MIP-3b); CCL2 (MCP-1); MCAF; CCL2O (MIP-3a); CCL21 (MIP-2); SLC; exodus-2; CCL22 (MDC/STC-1); CCL23 (MPIF-1); CCL24 (MPIF-2 I eotaxin-2); CCL25 (TECK); CCL26 (eotaxin-3); CCL27 (CTACK/ILC); CCL28; CCL3 (MIP-1a); CCL4 (MIP-1b); CCL5 (RANTES); CCL7 (MCP-3); CCL8 (mcp-2); CCNA1; CCNA2; CCND1; CCNE1; CCNE2; CCR1 (CKR1/HM145); CCR2 (mcp-1RB/RA); CCR3 (CKR3/CMKBR3); CCR4; CCR5 (CMKBR5/ChemR13); CCR6 (CMKBR6/CKR-L3/STRL22/DRY6); CCR7 (CKR7/EBI1); CCR8 (CMKBR8/TER1/CKR-L1); CCR9 (GPR-9-6); CCRL1 (VSHK1); CCRL2 (L-CCR); CD7, CD164; CD19; CD1C; CD2O; CD200; CD-22; CD24; CD28; CD3; CD37; CD38; CD3E; CD3G; CD3Z; CD4; CD4O; CD4OL; CD44; CD45RB; CD52; CD69; CD72; CD74; CD79A; CD79B; CD8; CD8O; CD81; CD83; CD86; CD96; CD207; CDH1 (E-cadherin); CDH10; CDH12; CDH13; CDH18; CDH19; CDH20; CDH5; CDH7; CDH8; CDH9; CDK2; CDK3; CDK4; CDK5; CDK6; CDK7; CDK9; CDKN1A (p21Wap1/Cip1); CDKN1B (p27Kip1); CDKNIC; CDKN2A (p161NK4a); CDKN2B; CDKN2C; CDKN3; CEBPB; CELSR3; CER1; CHGA; CHGB; Chitinase; CHRNG; CHST10; CKLFSF2; CKLFSF3; CKLFSF4; CKLFSF5; CKLFSF6; CKLFSF7; CKLFSF8; CLDN3; CLDN7 (claudin-7); CLN3; CLU (clusterin); CMKLR1; CMKOR1 (RDC1); CNR1; COL18A1; COL1A1; COL4A3; COL6A1; CR2; CRP; CSF1 (M-CSF); CRLF2; CSF2 (GM-CSF); CSF3 (GCSF); CTLA4; CTNNB1 (b-catenin); CTSB (cathepsin B); CX3CL1 (SCYDi); CX3CR1 (V28); CXCR6; CXCL1 (GRO1); CXCL1O (IP-10); CXCL11 (I-TAC/IP-9); CXCL12 (SDF1); CXCL13; CXCL14; CXCL16; CXCL2 (GRO2); CXCL3 (GRO3); CXCL5 (ENA-78 I LIX); CXCL6 (GCP-2); CXCL9 (MIG); CXCR3 (GPR9/CKR-L2); CXCR4; CXCR6 (TYMSTR ISTRL33 I Bonzo); CYB5; CYC1; CYSLTR1; DAB2IP; DAND5; DES; DKFZp451J0118; DNCL1; DPP4; E2F1; ECGF1; EDG1; EFNAI; EFNA3; EFNB2; EGF; EGFR; ELAC2; ENG; ENO1; ENO2; ENO3; EphA4; EPHB4; EPO; ERBB2 (Her-2); EREG; ERK8; ESR1; ESR2; F3 (TF); FADD; FasL; FASN; FCER1A; FCER2; FCGR3A; FCRL4; FGF; FGF1 (aFGF); FGF1O; FGF11; FGF12; FGF12B; FGF13; FGF14; FGF16; FGF17; FGF18; FGF19; FGF2 (bFGF); FGF2O; FGF21; FGF22; FGF23; FGF3 (int-2); FGF4 (HST); FGF5; FGF6 (HST-2); FGF7 (KGF); FGF8; FGF9; FGFR3; FIGF (VEGFD); FIL1 (EPSILON); FIL1 (ZETA); FLJ12584; FLJ25530; FLRT1 (fibronectin); FLT1; FOS; FOSL1 (FRA-1); FY (DARC); GABRP (GABAa); GAGEB1; GAGEC1; Galectin-3; GALNAC4S-65T; GATA3; GDF5; GFI1; GGT1; GHR; GM-CSF; GNAS1; GNRH1; GPR2 (CCR1O); GPR31; GPR44; GPR81 (FKSG8O); GPR87; GPR137C; GRCC10 (C10); GRP; GSN (Gelsolin); GSTP1; HAVCR1; HAVCR2; HDAC4; EDAC5; HDAC7A; HDAC9; hepcidin; hemojuvelin; HGF; HIF1A; HIP1; histamine and histamine receptors; HLA-A; HLA-DRA; HM74; HMOX1; HUMCYT2A; ICEBERG; ICOS; 1D2; IFN-a; IFNA1; IFNA2; IFNA4; IFNA5; IFNA6; IFNA7; IFNB1; IFN-gamma; TFNW1; IGBP1; IGF1; IGF1R; IGF2; IGFBP2; IGFBP3; IGFBP6; IL-1; IL10; IL10RA; IL10RB; IL11; IL11RA; IL-12; IL12A; IL12B; IL12RB1; IL12RB2; 1L13; IL13RA1; IL13RA2; 1L14; 1L15; IL15RA; IL16; 1L17; IL17B; IL17C; IL17R; 1L18; IL18BP; IL18R1; IL18RAP; 1L19; IL1A; IL1B; IL1F1O; IL1F5; IL1F6; IL1F7; IL1F8; IL1F9; IL1HY1; IL1R1; IL1R2; IL1RAP; IL1RAPL1; IL1RAPL2; IL1RL1; IL1RL2 IL1RN; 1L2; 1L20; IL2ORA; IL21R; 1L22; 1L22R; 1L22RA2; 1L23; 1L24; 1L25; 1L26; 1L27; IL28A; 1L28B; 1L29; IL2RA; IL2RB; IL2RG; 1L3; 1L30; IL3RA; 1L4; IL4R; 1L5; IL5RA; 1L6; IL6 receptor; IL6ST (glycoprotein 130); 1L7; TL7R; 1L8; IL8RA; IL8RB; IL8RB; 1L9; IL9R; ILK; INHA; INHBA; INSL3; INSL4; IRAK1; IRAK2; ITGA1; ITGA2; 1TGA3; ITGA6 (a6 integrin); ITGAV; ITGB3; ITGB4 (b 4 integrin); JAG1; JAK1; JAK3; JUN; K6HF; KAI1; KDR; MTLG; KLF5 (GC Box BP); KLF6; KLK10; KLK12; KLK13; KLK14; KLK15; KLK3; KLK4; KLK5; KLK6; KLK9; KRT1; KRT19 (Keratin 19); KRT2A; KRTHB6 (hair-specific type II keratin); LAG3; LAMA5; LEP (leptin); LIGHT; Lingo-p75; Lingo-Troy; LPS; LRP5; LTA (TNF-b); LTB; LTB4R (GPR16); LTB4R2; LTBR; MACMARCKS; MAG or Omgp; MAP2K7 (c-Jun); MDK; MIB1; midkine; MIF; MIP-2; MK167 (Ki-67); MMP2; MMP9; MS4A1; MSMB; MT3 (metallothionectin-ifi); MTSS 1; MUC 1 (mucin); MYC; MYD88; NCK2; neurocan; Na$_v$1.7; Na$_v$1.8; NFKB 1; NFKB2; NGFB (NGF); NGFR; NgR-Lingo; NgR-Nogo66 (Nogo); NgR-p75; NgR-Troy; NME1 (NM23A); NOX5; NPPB; NROB1; NROB2; NR1D1; NR1D2; NR1H2; NR1H3; NR1H4; NR1I2; NR1I3; NR2C1; NR2C2; NR2E1; NR2E3; NR2F1; NR2F2; NR2F6; NR3C1; NR3C2; NR4A1; NR4A2; NR4A3; NR5A1; NR5A2; NR6A1; NRP1; NRP2; NT5E; NTN4; ODZ1; OPG; OPRD1; OX40L; OX40; P2RX7; PAP; PART1; PATE;

PAWR; PCA3; PCNA; PCSK9, PD-1, PD-L1; PDGFA; PDGFB; PECAM1; PF4 (CXCL4); PGF; PGR; phosphacan; PIAS2; Placental Growth Factor (PIGF); PIK3CG; PLAU (uPA); PLG; PLXDC1; PPBP (CXCL7); PPID; PR1; PRKCQ; PRKD1; PRL; PROC; PROK2; PSAP; PSCA; PTAFR; PTEN; PTGS2 (COX-2); PTN; RAC2 (p21Rac2); RARB; RGS1; RGS13; RGS3; RNF11O (ZNF144); ROBO2; ROR1; S100A2; SCGB1D2 (lipophilin B); SCGB2A1 (mammaglobin 2); SCGB2A2 (mammaglobin 1); SCYE1 (endothelial Monocyte-activating cytokine); SDF2; SERPINA1; SERPINIA3; SERPINB5 (maspin); SERPINE1 (PAT-i); SERPINF1; SHBG; SLA2; SLC2A2; SLC33A1; SLC43A1; SLIT2; SPP1; SPRR1B (Spri); ST6GAL1; STAB1; STATE; STEAP; STEAP2; TB4R2; TBX21; TCP1O; TDGF1; TEK; TGFA; TGFB1; TGFB1l1; TGFB2; TGFB3; TGFBI; TGFBR1; TGFBR2; TGFBR3; TH1L; THBS1 (thrombospondin-1); THBS2; THBS4; THPO; TIE (Tie-i); TIM3; TMP3; tissue factor; TLR1O; TLR2; TLR3; TLR4; TLR5; TLR6; TLR7; TLR8; TLR9; TMPRSS6; TNF; TNF-a; TNFAIP2 (B94); TNFAIP3; TNFRSF1 1A; TNFRSF1A; TNFRSF1B; TNFRSF21; TNFRSF5; TNFRSF6 (Fas); TNFRSF7; TNFRSF8; TNFRSF9; TNFSF1O (TRAIL); TNFSF1 1 (TRANCE); TNFSF12 (APO3L); TNFSF13 (April); TNFSF13B; TNFSF14 (HVEM-L); TNFSF1 5 (VEGI); TNFSF1 8; TNFSF4 (0X40 ligand); TNFSF5 (CD4O ligand); TNFSF6 (FasL); TNFSF7 (CD27 ligand); TNFSF8 (CD3O ligand); TNFSF9 (4-1BB ligand); TOLLIP; Toll-like receptors; TOP2A (topoisomerase lia); TP53; TPM1; TPM2; TRADD; TRAF1; TRAF2; TRAF3; TRAF4; TRAF5; TRAF6; TRAIL; TREM1; TREM2; TRPC6; TSLP; TWEAK; VEGFA; VEGFB; VEGFC; versican; VHL C5; VLA-4; Wnt7A; XCL1 (lymphotactin); XCL2 (SCM-1b); XCR1 (GPR5/CCXCR1); YY1; and ZFPM2.

In an example, the TOI is a human TOI selected from Table 5.

In an example, the TOI is OX40 ligand.
In an example, the TOI is OX40.
In an example, the TOI is PCSK9.
In an example, the TOI is IL6 receptor (IL-6R).
In an example, the TOI is LIGHT.
In an example, the TOI is VEGF-A.
In an example, the TOI is TNF alpha.
In an example, the TOI is PIGF.
In an example, the TOI is IGF1R.
In an example, the TOI is OPG.
In an example, the TOI is ICOS
In an example, the TOI is NGF.
In an example, the TOI is BMP6.
In an example, the TOI is ferroportin.
In an example, the TOI is TMPRSS6.
In an example, the TOI is hemojuvelin.
In an example, the TOI is VEGF receptor.
In an example, the TOI is PDGF receptor.
In an example, the TOI is stem cell factor receptor.
In an example, the TOI is hepcidin.
In an example, the TOI is IL-4 receptor alpha.
In an example, the TOI is sclerostin.
In an example, the TOI is IL-13 receptor.
In an example, the TOI is CD7.
In an example, the TOI is delta-like ligand-4 (Dll4).
In an example, the TOI is HGF.
In an example, the TOI is angiopoietin-2 (Ang2).
In an example, the TOI is GDF8.
In an example, the TOI is ERBB3.
In an example, the TOI is IL-17 receptor.
In an example, the TOI is CD40.
In an example, the TOI is CD40 ligand.
In an example, the TOI is EGFR.

In an example, the TOI comprises a mutation as described herein for that TOI or is encoded by a nucleotide sequence comprising a SNP as described herein for that TOI. Optionally, additionally the human comprises said TOI comprising said mutation; or the human comprises a nucleotide sequence encoding said TOI comprising said mutation.

For example, the TOI is human PCSK9 and comprises a mutation 1474, E670G, N425S or Q619P in SEQ ID NO: 1. Optionally, additionally the human comprises said PCSK9 comprising said mutation; or the human comprises a nucleotide sequence encoding said PCSK9 comprising said mutation. In an alternative, for example herein where a PCSK9 is stated to be of a specific "form", eg, form f, c, r, p, e, h, aj or q, in the alternative the PCSK9 is a human PCSK9 comprising a mutation R46L, A53V, N425S, A443T, I474V, Q619P and E670G (eg, comprises a mutation 1474, E670G, N425S or Q619P) in SEQ ID NO: 1; for example, the PCSK9 comprises I474V in SEQ ID NO: 1 and optionally the human comprises such a PCSK9 or a nucleotide sequence encoding such a PCSK9 (eg, wherein the method is for treating or preventing dislipidemia, eg reducing cholesterol or maintaining reduced cholesterol in the human); for example, the PCSK9 comprises E670G in SEQ ID NO: 1 and optionally the human comprises such a PCSK9 or a nucleotide sequence encoding such a PCSK9 (eg, wherein the method is for treating or preventing dislipidemia, eg reducing cholesterol or maintaining reduced cholesterol in the human); for example, the PCSK9 comprises Q619P in SEQ ID NO: 1 and optionally the human comprises such a PCSK9 or a nucleotide sequence encoding such a PCSK9 (eg, wherein the method is for treating or preventing dislipidemia, eg reducing cholesterol or maintaining reduced cholesterol in the human); for example, the PCSK9 comprises N425S in SEQ ID NO: 1 and optionally the human comprises such a PCSK9 or a nucleotide sequence encoding such a PCSK9 (eg, wherein the method is for treating or preventing dislipidemia, eg reducing cholesterol or maintaining reduced cholesterol in the human); for example, the PCSK9 comprises R46L in SEQ ID NO: 1 and optionally the human comprises such a PCSK9 or a nucleotide sequence encoding such a PCSK9 (eg, wherein the method is for treating or preventing dislipidemia, eg increasing cholesterol in the human); for example, the PCSK9 comprises A53V in SEQ ID NO: 1 and optionally the human comprises such a PCSK9 or a nucleotide sequence encoding such a PCSK9 (eg, wherein the method is for treating or preventing dislipidemia, eg increasing cholesterol in the human); for example, the PCSK9 comprises A443T in SEQ ID NO: 1 and optionally the human comprises such a PCSK9 or a nucleotide sequence encoding such a PCSK9 (eg, wherein the method is for treating or preventing dislipidemia, eg increasing cholesterol in the human).

For example, the TOI is human IL6R and comprises a mutation D358A or V385I in SEQ ID NO: 78. Optionally, additionally the human comprises said IL6R comprising said mutation; or the human comprises a nucleotide sequence encoding said IL6R comprising said mutation.

For example, the TOI is human IL4Ra and comprises a mutation selected from the group consisting of I75V, E400A, C431R, S503P, Q576R and S752A in SEQ ID NO: 67. Optionally, additionally the human comprises said IL4Ra comprising said mutation; or the human comprises a nucleotide sequence encoding said IL4Ra comprising said mutation.

For example, the TOI is huma Nav1.7 and comprises a mutation selected from the group consisting of 136I, 216S, 241T, 395K, 848T, 858H, 858F, 863P, 1449V, 996C, 1298F, 1298D, 1299F, 1461T, 1462V, 1464I, 1627K, 277X (wherein X is an amino acid other than R), 328X (wherein X is an amino acid other than Y), 395K, 459X (wherein X is an amino acid other than S), 693 X (wherein X is an amino acid other than E), 767X (wherein X is an amino acid other than I), 830X (wherein X is an amino acid other than R), 897X (wherein X is an amino acid other than W), 1200L, 1235L, 1488X (wherein X is an amino acid other than R), 1659X (wherein X is an amino acid other than K), 1689X (wherein X is an amino acid other than W), 422D, 490N, 943L, 1002L, 1161W and 1919G, eg, the mutation is 1161W. Optionally, additionally the human comprises said Nav1.7 comprising said mutation; or the human comprises a nucleotide sequence encoding said Nav1.7 comprising said mutation.

For example, the TOI is human VEGF-A and is encoded by a VEGF-A nucleotide sequence comprising a SNP selected from the group consisting of rs699947, rs833061, rs2010963, rs3025039, rs699946, rs2146323, rs1413711, rs833068, rs833069, rs3025000 and rs1570360. Optionally, additionally the human comprises said VEGF-A comprising said mutation; or the human comprises a nucleotide sequence encoding said VEGF-A comprising said mutation.

For example, the TOI is human PDGF-B and is encoded by a PDGF-B nucleotide sequence comprising a SNP selected from the group consisting of rs142404523 (ie, a C corresponding to position −776) and a C at the position of rs1800818 (ie, a C corresponding to position −735). Optionally, additionally the human comprises said PDGF-B comprising said mutation; or the human comprises a nucleotide sequence encoding said PDGF-B comprising said mutation.

For example, the TOI is human PDGFR-B and is encoded by a PDGFR-B nucleotide sequence comprising a SNP selected from the group consisting of rs246395 (ie, a G corresponding to position 2601) and rs74943037 (ie, a T corresponding to position 1391). Optionally, additionally the human comprises said PDGFR-B comprising said mutation; or the human comprises a nucleotide sequence encoding said PDGFR-B comprising said mutation.

For convenience, the meaning of some terms and phrases used in the specification, examples, and appended claims, are provided below. Unless stated otherwise, or implicit from context, the following terms and phrases include the meanings provided below. The definitions are provided to aid in describing particular embodiments, and are not intended to limit the claimed invention, because the scope of the invention is limited only by the claims. Unless otherwise defined, all technical and scientific terms used herein have the same meaning as commonly understood by one of ordinary skill in the art to which this invention belongs. If there is an apparent discrepancy between the usage of a term in the art and its definition provided herein, the definition provided within the specification shall prevail.

For convenience, certain terms employed herein, in the specification, examples and appended claims are collected here.

The terms "decrease", "reduced", or "reduction" are all used herein to mean a decrease by a statistically significant amount. In some embodiments, "reduce," "reduction" or "decrease" typically means a decrease by at least 10% as compared to a reference level (e.g. the absence of a given treatment) and can include, for example, a decrease by at least about 10%, at least about 20%, at least about 25%, at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 95%, at least about 98%, at least about 99%, or more. As used herein, "reduction" does not encompass a complete reduction as compared to a reference level. A decrease can be preferably down to a level accepted as within the range of normal for an individual without a given disorder. However, for example, for the purposes of lowering or reducing cholesterol level, for example, a reduction by about 5-10 points can be considered a "decrease" or "reduction."

In certain aspects of all embodiments of the invention, the term "inhibition" is used. Inhibition refers and refers to decrease by at least 10% as compared to a reference level (e.g. the absence of a given treatment) and can include, for example, a decrease by at least about 10%, at least about 20%, at least about 25%, at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 95%, at least about 98%, at least about 99%, or more including 100% inhibition as compared to a reference level. "Complete inhibition" refers to a 100% inhibition as compared to a reference level.

The terms "increased", "increase", "enhance", or "activate" are all used herein to mean an increase by a statically significant amount. In some embodiments, the terms "increased", "increase", "enhance", or "activate" can mean an increase of at least 10% as compared to a reference level, for example an increase of at least about 20%, or at least about 30%, or at least about 40%, or at least about 50%, or at least about 60%, or at least about 70%, or at least about 80%, or at least about 90% or up to and including a 100% increase or any increase between 10-100% as compared to a reference level, or at least about a 2-fold, or at least about a 3-fold, or at least about a 4-fold, or at least about a 5-fold or at least about a 10-fold increase, or any increase between 2-fold and 10-fold or greater as compared to a reference level. In the context of a marker or symptom, an "increase" is a statistically significant increase in such level.

As used herein, the term "substantially" refers to the qualitative condition of exhibiting total or near-total extent or degree of a characteristic or property of interest. One of ordinary skill in the biological arts will understand that biological and chemical phenomena rarely, if ever, go to completion and/or proceed to completeness or achieve or avoid an absolute result. The term "substantially" is therefore used herein to capture the potential lack of completeness inherent in many biological and chemical phenomena. For the removal of doubt, "substantially" can refer to at least a 90% extent or degree of a characteristic or property of interest, e.g. at least 90%, at least 92%, at least 95%, at least 98%, at least 99% or greater.

As used herein, a "subject" means a human or animal. Usually the animal is a vertebrate such as a primate, rodent, domestic animal or game animal Primates include chimpanzees, cynomologous monkeys, spider monkeys, and macaques, e.g., Rhesus. Rodents include mice, rats, woodchucks, ferrets, rabbits and hamsters. In some embodiments, the subject is a mammal, e.g., a primate, e.g., a human. The terms, "individual," "patient" and "subject" are used interchangeably herein. In some embodiments, the subject can be a non-human vertebrate, e.g. a primate, a rodent, a mouse, a rat, a pig, a sheep, a zebrafish, a frog, etc.

Preferably, the subject is a mammal. The mammal can be a human, non-human primate, mouse, rat, dog, cat, horse, or cow, but is not limited to these examples. Mammals other than humans can be advantageously used as subjects that represent animal models of a disease or condition, e.g., a cardiovascular condition. A subject can be male or female.

A subject can be one who has been previously diagnosed with or identified as suffering from or having a condition in need of treatment or one or more complications related to such a condition, and optionally, have already undergone treatment for the condition or the one or more complications related to the condition. Alternatively, a subject can also be one who has not been previously diagnosed as having the condition or one or more complications related to the condition. For example, a subject can be one who exhibits one or more risk factors for the condition or one or more complications related to the condition or a subject who does not exhibit risk factors.

A "subject in need" or "human in need" of treatment for a particular condition can be a subject having that condition, such as increased cholesterol levels, diagnosed as having that condition, or at risk of developing that condition.

As used herein, the terms "protein" and "polypeptide" are used interchangeably herein to designate a series of amino acid residues, connected to each other by peptide bonds between the alpha-amino and carboxy groups of adjacent residues. The terms "protein", and "polypeptide" refer to a polymer of amino acids with natural amino acids. When referring to "modified polypeptides" one refers to polypeptides that include modified amino acids (e.g., phosphorylated, glycated, glycosylated, etc.) and amino acid analogs, regardless of its size or function. "Protein" and "polypeptide" are often used in reference to relatively large polypeptides, whereas the term "peptide" is often used in reference to small polypeptides, but usage of these terms in the art overlaps. The terms "protein" and "polypeptide" are used interchangeably herein when referring to a gene product and fragments thereof. Thus, exemplary polypeptides or proteins include gene products, naturally occurring proteins with the specified sequence. One can also use peptide homologs, peptide orthologs, peptide paralogs, peptide fragments and other equivalents, variants, fragments, and analogs of the peptides as these terms are understood by one of ordinary skill in the art.

As used herein, the term "nucleic acid" or "nucleic acid sequence" refers to any molecule, preferably a polymeric molecule, incorporating units of ribonucleic acid, deoxyribonucleic acid. The nucleic acid can be either single-stranded or double-stranded. A single-stranded nucleic acid can be one nucleic acid strand of a denatured double-stranded DNA. Alternatively, it can be a single-stranded nucleic acid not derived from any double-stranded DNA. In one aspect, the nucleic acid can be DNA. In another aspect, the nucleic acid can be RNA. Suitable nucleic acid molecules are DNA, including genomic DNA or cDNA. Other suitable nucleic acid molecules are RNA, including mRNA. In some aspects one can also use analogs of nucleic acids.

As used herein, the term "nucleic acid probe" refers to an isolated oligonucleotide molecule having a nucleic acid sequence which can hybridize to a target nucleic acid sequence, e.g. specifically hybridize to the target sequence. In some embodiments, a nucleic acid probe can further comprise a detectable label. In some embodiments, a nucleic acid probe can be attached to a solid surface. In some embodiments, a nucleic acid from is from about 5 nt to about 100 nt in length.

As used herein, the term "siRNA" refers to a nucleic acid that forms an RNA molecule comprising two individual strands of RNA which are substantially complementary to each other. Typically, the siRNA is at least about 15-40 nucleotides in length (e.g., each complementary sequence of the double stranded siRNA is about 15-40 nucleotides in length, and the double stranded siRNA is about 15-40 base pairs in length, preferably about 19-25 base nucleotides, e.g., 19, 20, 21, 22, 23, 24, or 25 nucleotides in length). In some embodiments, a siRNA can be blunt-ended. In some embodiments, a siRNA can comprise a 3' and/or 5' overhang on each strand having a length of about 0, 1, 2, 3, 4, or 5 nucleotides. The length of the overhang is independent between the two strands, i.e., the length of the overhang on one strand is not dependent on the length of the overhang on the second strand. The siRNA molecules can also comprise a 3' hydroxyl group. In some embodiments, the siRNA can comprise a 5' phosphate group. A siRNA has the ability to reduce or inhibit expression of a gene or target RNA when the siRNA is present or expressed in the same cell as the target gene, e.g. the target RNA. siRNA-dependent post-transcriptional silencing of gene expression involves cutting the target RNA molecule at a site guided by the siRNA.

As used herein, "PCSK9" or "proprotein convertase subtilisin/kexin type 9" refers to a serine protease involved in regulating the levels of the low density lipoprotein receptor (LDLR) protein (Horton et al., 2007; Seidah and Prat, 2007). PCSK9 has been shown to directly interact with the LDLR protein, be endocytosed along with the LDLR, and co-immunofluoresce with the LDLR throughout the endosomal pathway (Lagace et al., 2006). PCSK9 is a prohormone-proprotein convertase in the subtilisin (S8) family of serine proteases (Seidah et al., 2003). The sequence of PCSK9 for a variety of species is known, e.g., human PCSK9 (NCBI Gene ID No: 255738). Nucleotide and polypeptide sequences for a number of PCSK9 isoforms are provided herein, e.g., SEQ ID NOs: 1-37.

PCSK9 exists as both a pro-form and a mature form. Autocatalysis of the PCSK9 proform occurs between Gln152 and Ser153 (VFAQ|SIP (SEQ ID NO: 116)) (Naureckiene et al., 2003), and has been shown to be required for its secretion from cells (Seidah et al., 2003). The inactive form prior to this cleavage can be referred to herein as the "inactive", "pro-form", or "unprocessed" form of PCSK9. The C-terminal fragment generated by the autocatalysis event can be referred to herein as the "mature," "cleaved", "processed" or "active" PCSK9. Examples of pro-form and mature PCSK9 isoforms are provided herein, see, e.g. SEQ ID NOs: 1-27.

As used herein, the "catalytic domain" of PCSK9 refers to the portion of a PCSK9 polypeptide corresponding to positions 153 to 449 of PCSK9, e.g. of SEQ ID NO: 1. As used herein, the "C-terminal domain" of PCSK9 refers to the portion of a PCSK9 polypeptide corresponding to positions 450-692 of PCSK9, e.g., of SEQ ID NO: 1.

As used herein, a disease or condition "mediated by PCSK9" refers to a disease or condition which is caused by or characterized by a change in PCSK9, e.g. a change in expression level, a change in activity, and/or the presence of a variant or mutation of PCSK9. Non-limiting examples of such diseases or conditions can include, for example, a lipid disorder, hyperlipoproteinemia, hyperlipidemia; dyslipidemia; hypercholesterolemia, a heart attack, a stroke, coronary heart disease, atherosclerosis, peripheral vascular disease, claudication (eg, claudication associated with elevated cholesterol), type II diabetes, high blood pressure, and a cardiovascular disease or condition. Another example is acute coronary syndrome. In an example, the disease or condition is an inflammatory or autoimmune disease or condition. Methods of identifying and/or diagnosing such diseases and conditions are well known to medical practitioners of ordinary skill.

A subject at risk of having or developing a disease or condition mediated by PCSK9 can be a subject exhibiting one or more signs or symptoms of such a disease or condition or having one or more risk factors for such a disease or condition, e.g. being overweight, having elevated cholesterol level, comprising one or more genetic polymorphisms known to predispose to the disease or condition, e.g., elevated cholesterol level, such as having a mutation in the LDLR (encoding low-density lipoprotein receptor) or APOB (encoding apolipoprotein B) or in the PCSK9 gene and/or having a family history of such a disease or condition.

As used herein, "ligand" refers to a molecule which can bind, e.g., specifically bind, to a second molecule or receptor. In some embodiments, a ligand can be, e.g., an antibody, antibody fragment, antibody portion, and/or affibody.

The term "variant" as used herein refers to a peptide or nucleic acid that differs from the polypeptide or nucleic acid (eg, the most common one in humans, eg, most frequent in a database as disclosed herein, such as the 1000 Genomes Project database) by one or more amino acid or nucleic acid deletions, additions, yet retains one or more specific functions or biological activities of the naturally occurring molecule Amino acid substitutions include alterations in which an amino acid is replaced with a different naturally-occurring amino acid residue. Such substitutions may be classified as "conservative", in which case an amino acid residue contained in a polypeptide is replaced with another naturally occurring amino acid of similar character either in relation to polarity, side chain functionality or size. Such conservative substitutions are well known in the art. Substitutions encompassed by the present invention may also be "non-conservative", in which an amino acid residue which is present in a peptide is substituted with an amino acid having different properties, such as naturally-occurring amino acid from a different group (e.g., substituting a charged or hydrophobic amino; acid with alanine), or alternatively, in which a naturally-occurring amino acid is substituted with a non-conventional amino acid. In some embodiments amino acid substitutions are conservative. Also encompassed within the term variant when used with reference to a polynucleotide or polypeptide, refers to a polynucleotide or polypeptide that can vary in primary, secondary, or tertiary structure, as compared to a reference polynucleotide or polypeptide, respectively (e.g., as compared to a wild-type polynucleotide or polypeptide).

Variants of PCSK9 are provided elsewhere herein. Variants of PCSK9 can include the forms described herein as a, f, c, r, p, m, e h, aj, and q. Sequences of these variants are provided herein, see, e.g, SEQ ID NOs:1-27 and in Table 1, 2 or 6.

In some aspects, one can use "synthetic variants", "recombinant variants", or "chemically modified" polynucleotide variants or polypeptide variants isolated or generated using methods well known in the art. "Modified variants" can include conservative or non-conservative amino acid changes, as described below. Polynucleotide changes can result in amino acid substitutions, additions, deletions, fusions and truncations in the polypeptide encoded by the reference sequence. Some aspects use include insertion variants, deletion variants or substituted variants with substitutions of amino acids, including insertions and substitutions of amino acids and other molecules) that do not normally occur in the peptide sequence that is the basis of the variant, for example but not limited to insertion of ornithine which do not normally occur in human proteins. The term "conservative substitution," when describing a polypeptide, refers to a change in the amino acid composition of the polypeptide that does not substantially alter the polypeptide's activity. For example, a conservative substitution refers to substituting an amino acid residue for a different amino acid residue that has similar chemical properties. Conservative amino acid substitutions include replacement of a leucine with an isoleucine or valine, an aspartate with a glutamate, or a threonine with a serine.

"Conservative amino acid substitutions" result from replacing one amino acid with another having similar structural and/or chemical properties, such as the replacement of a leucine with an isoleucine or valine, an aspartate with a glutamate, or a threonine with a serine. Thus, a "conservative substitution" of a particular amino acid sequence refers to substitution of those amino acids that are not critical for polypeptide activity or substitution of amino acids with other amino acids having similar properties (e.g., acidic, basic, positively or negatively charged, polar or non-polar, etc.) such that the substitution of even critical amino acids does not reduce the activity of the peptide, (i.e. the ability of the peptide to penetrate the blood brain barrier (BBB)). Conservative substitution tables providing functionally similar amino acids are well known in the art. For example, the following six groups each contain amino acids that are conservative substitutions for one another: 1) Alanine (A), Serine (S), Threonine (T); 2) Aspartic acid (D), Glutamic acid (E); 3) Asparagine (N), Glutamine (Q); 4) Arginine (R), Lysine (K); 5) Isoleucine (I), Leucine (L), Methionine (M), Valine (V); and 6) Phenylalanine (F), Tyrosine (Y), Tryptophan (W). (See also Creighton, Proteins, W. H. Freeman and Company (1984), incorporated by reference in its entirety.) In some embodiments, individual substitutions, deletions or additions that alter, add or delete a single amino acid or a small percentage of amino acids can also be considered "conservative substitutions" if the change does not reduce the activity of the peptide. Insertions or deletions are typically in the range of about 1 to 5 amino acids. The choice of conservative amino acids may be selected based on the location of the amino acid to be substituted in the peptide, for example if the amino acid is on the exterior of the peptide and expose to solvents, or on the interior and not exposed to solvents.

In alternative embodiments, one can select the amino acid which will substitute an existing amino acid based on the location of the existing amino acid, i.e. its exposure to solvents (i.e. if the amino acid is exposed to solvents or is present on the outer surface of the peptide or polypeptide as compared to internally localized amino acids not exposed to solvents). Selection of such conservative amino acid substitutions are well known in the art, for example as disclosed in Dordo et al, J. MoI Biol, 1999, 217, 721-739 and Taylor et al, J. Theor. Biol. 119(1986); 205-218 and S. French and B. Robson, J. MoI. Evol. 19(1983)171. Accordingly, one can select conservative amino acid substitutions suitable for amino acids on the exterior of a protein or peptide (i e amino acids exposed to a solvent), for example, but not limited to, the following substitutions can be used: substitution of Y with F, T with S or K, P with A, E with D or Q, N with D or G, R with K, G with N or A, T with S or K, D with N or E, I with L or V, F with Y, S with T or A, R with K, G with N or A, K with R, A with S, K or P.

In alternative embodiments, one can also select conservative amino acid substitutions encompassed suitable for amino acids on the interior of a protein or peptide, for example one can use suitable conservative substitutions for amino acids is on the interior of a protein or peptide (i.e. the amino acids are not exposed to a solvent), for example but not limited to, one can use the following conservative substitutions: where Y is substituted with F, T with A or S, I with L or V, W with Y, M with L, N with D, G with A, T with A or S, D with N, I with L or V, F with Y or L, S with A or T and A with S, G, T or V. In some embodiments, non-conservative amino acid substitutions are also encompassed within the term of variants.

As used herein an "antibody" refers to IgG, IgM, IgA, IgD or IgE molecules or antigen-specific antibody fragments thereof (including, but not limited to, a Fab, F(ab')$_2$, Fv, disulphide linked Fv, scFv, single domain antibody, closed conformation multispecific antibody, disulphide-linked scfv, diabody), whether derived from any species that naturally produces an antibody, or created by recombinant DNA technology; whether isolated from serum, B-cells, hybridomas, transfectomas, yeast or bacteria. Antibodies can be humanized using routine technology.

As described herein, an "antigen" is a molecule that is bound by a binding site on an antibody agent. Typically, antigens are bound by antibody ligands and are capable of raising an antibody response in vivo. An antigen can be a polypeptide, protein, nucleic acid or other molecule or portion thereof. The term "antigenic determinant" refers to an epitope on the antigen recognized by an antigen-binding molecule, and more particularly, by the antigen-binding site of said molecule.

As used herein, the term "antibody fragment" refers to a polypeptide that includes at least one immunoglobulin variable domain or immunoglobulin variable domain sequence and which specifically binds a given antigen. An antibody fragment can comprise an antibody or a polypeptide comprising an antigen-binding domain of an antibody. In some embodiments, an antibody fragment can comprise a monoclonal antibody or a polypeptide comprising an antigen-binding domain of a monoclonal antibody. For example, an antibody can include a heavy (H) chain variable region (abbreviated herein as VH), and a light (L) chain variable region (abbreviated herein as VL). In another example, an antibody includes two heavy (H) chain variable regions and two light (L) chain variable regions. The term "antibody fragment" encompasses antigen-binding fragments of antibodies (e.g., single chain antibodies, Fab and sFab fragments, F(ab')2, Fd fragments, Fv fragments, scFv, and domain antibodies (dAb) fragments (see, e.g. de Wildt et al., Eur J. Immunol. 1996; 26(3):629-39; which is incorporated by reference herein in its entirety)) as well as complete antibodies. An antibody can have the structural features of IgA, IgG, IgE, IgD, IgM (as well as subtypes and combinations thereof). Antibodies can be from any source, including mouse, rabbit, pig, rat, and primate (human and non-human primate) and primatized antibodies. Antibodies also include midibodies, humanized antibodies, chimeric antibodies, and the like.

As used herein, "antibody variable domain" refers to the portions of the light and heavy chains of antibody molecules that include amino acid sequences of Complementarity Determining Regions (CDRs; ie., CDR1, CDR2, and CDR3), and Framework Regions (FRs). VH refers to the variable domain of the heavy chain. VL refers to the variable domain of the light chain. According to the methods used in this invention, the amino acid positions assigned to CDRs and FRs may be defined according to Kabat (Sequences of Proteins of Immunological Interest (National Institutes of Health, Bethesda, Md., 1987 and 1991)) or according to IMGT nomenclature.

D domain or region refers to the diversity domain or region of an antibody chain. J domain or region refers to the joining domain or region of an antibody chain.

An antibody "gene segment", e.g. a VH gene segment, D gene segment, or JH gene segment refers to oligonucleotide having a nucleic acid sequence that encodes that portion of an antibody, e.g. a VH gene segment is an oligonucleotide comprising a nucleic acid sequence that encodes a polypeptide VH domain.

The VH and VL regions can be further subdivided into regions of hypervariability, termed "complementarity determining regions" ("CDR"), interspersed with regions that are more conserved, termed "framework regions" ("FR"). The extent of the framework region and CDRs has been precisely defined (see, IMGT or Kabat, E. A., et al. (1991) Sequences of Proteins of Immunological Interest, Fifth Edition, U.S. Department of Health and Human Services, NIH Publication No. 91-3242, and Chothia, C. et al. (1987) J. Mol. Biol. 196:901-917; which are incorporated by reference herein in their entireties). Each VH and VL is typically composed of three CDRs and four FRs, arranged from amino-terminus to carboxy-terminus in the following order: FR1, CDR1, FR2, CDR2, FR3, CDR3, FR4.

The terms "antigen-binding fragment" or "antigen-binding domain", which are used interchangeably herein are used to refer to one or more fragments of a full length antibody that retain the ability to specifically bind to a target of interest. Examples of binding fragments encompassed within the term "antigen-binding fragment" of a full length antibody include (i) a Fab fragment, a monovalent fragment consisting of the VL, VH, CL and CH1 domains; (ii) a F(ab')2 fragment, a bivalent fragment including two Fab fragments linked by a disulfide bridge at the hinge region; (iii) an Fd fragment consisting of the VH and CH1 domains; (iv) an Fv fragment consisting of the VL and VH domains of a single arm of an antibody, (v) a dAb fragment (Ward et al., (1989) Nature 341:544-546; which is incorporated by reference herein in its entirety), which consists of a VH or VL domain; and (vi) an isolated complementarity determining region (CDR) that retains specific antigen-binding functionality.

As used herein, the term "antibody binding site" refers to a polypeptide or domain that comprises one or more CDRs of an antibody and is capable of binding an antigen. For example, the polypeptide comprises a CDR3 (eg, HCDR3). For example the polypeptide comprises CDRs 1 and 2 (eg, HCDR1 and 2) or CDRs 1-3 of a variable domain of an antibody (eg, HCDRs1-3). In an example, the antibody binding site is provided by a single variable domain (eg, a VH or VL domain). In another example, the binding site comprises a VH/VL pair or two or more of such pairs.

As used herein, the term "specific binding" refers to a chemical interaction between two molecules, compounds, cells and/or particles wherein the first entity binds to the second, target entity with greater specificity and affinity than it binds to a third entity which is a non-target. For example, in an diagnostic test the specific binding of a ligand can distinguish between two variant PCSK9 proteins as described herein. In some embodiments, specific binding can refer to an affinity of the first entity for the second target entity which is at least 10 times, at least 50 times, at least 100 times, at least 500 times, at least 1000 times or greater than the affinity for the third nontarget entity. In the context of oligonucleotide strands which interact via hybridization, specific binding can be "specific hybridization."

Additionally, and as described herein, a recombinant human(ized) antibody can be further optimized to decrease potential immunogenicity, while maintaining functional activity, for therapy in humans. In this regard, functional activity means a polypeptide capable of displaying one or more known functional activities associated with a recombinant antibody or antibody reagent thereof as described herein. Such functional activities include, e.g. the ability to bind to a target molecule.

The term "immunizing" refers to the step or steps of administering one or more antigens to an animal so that antibodies can be raised in the animal Generally, immunizing comprises injecting the antigen or antigens into the animal Immunization can involve one or more administrations of the antigen or antigens. Suitable methods are prime-boost and RIMMS procedures as known to the skilled person in the art.

As used herein, an "affibody" refers to a relatively small synthetic protein molecule that has high binding affinity for a target protein (e.g. for PCSK9 or a variant therefo). Affibodies are composed of a three-helix bundle domain derived from the IgG-binding domain of staphylococcal protein A. The protein domain consists of a 58 amino acid sequence, with 13 randomized amino acids affording a range of affibody variants. Despite being significantly smaller than an antibody (an affibody weighs about 6 kDa while an antibody commonly weighs about 150 kDa), an affibody molecule works like an antibody since its binding site is approximately equivalent in surface area to the binding site of an antibody.

Figure 3:
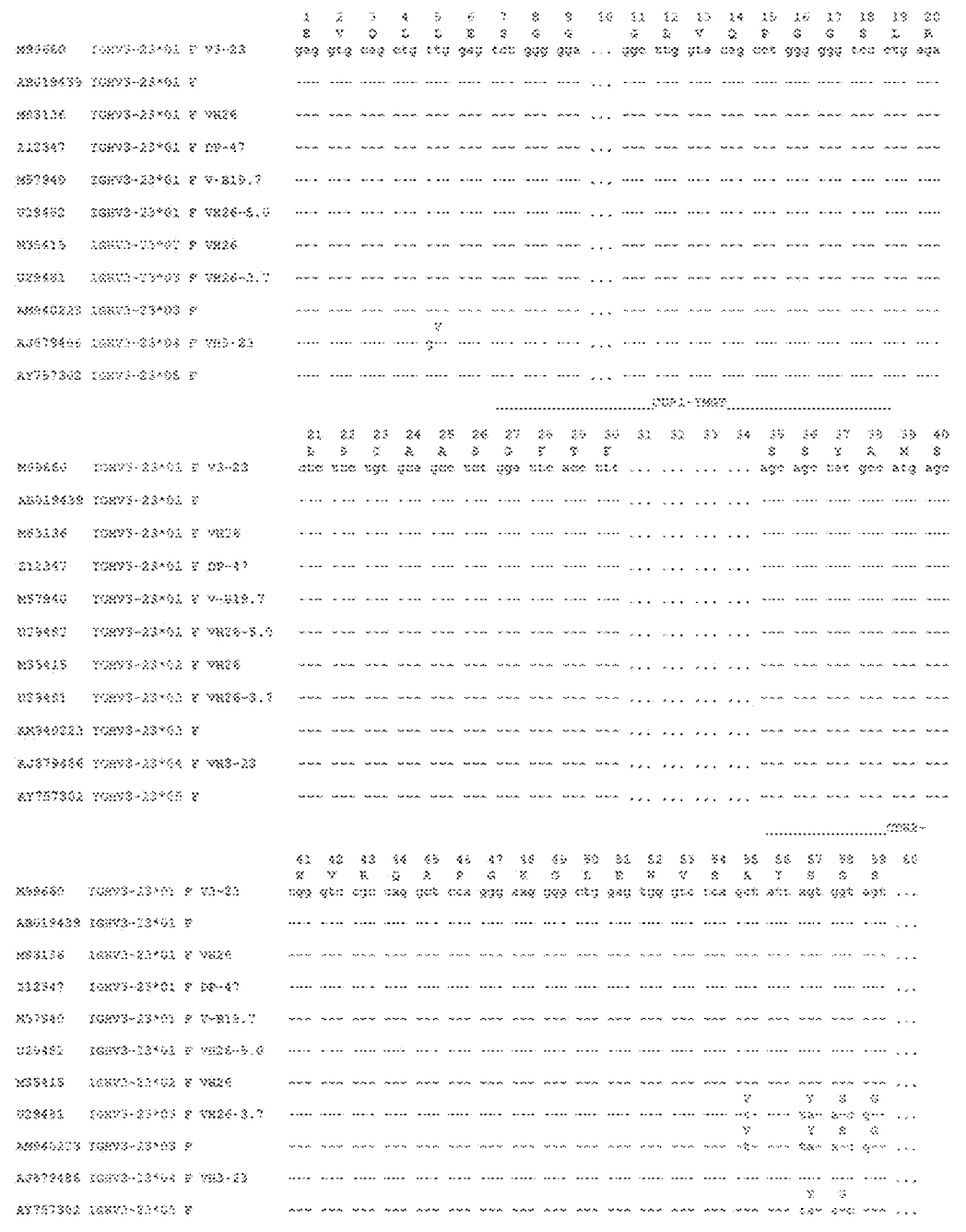
Figure 3:
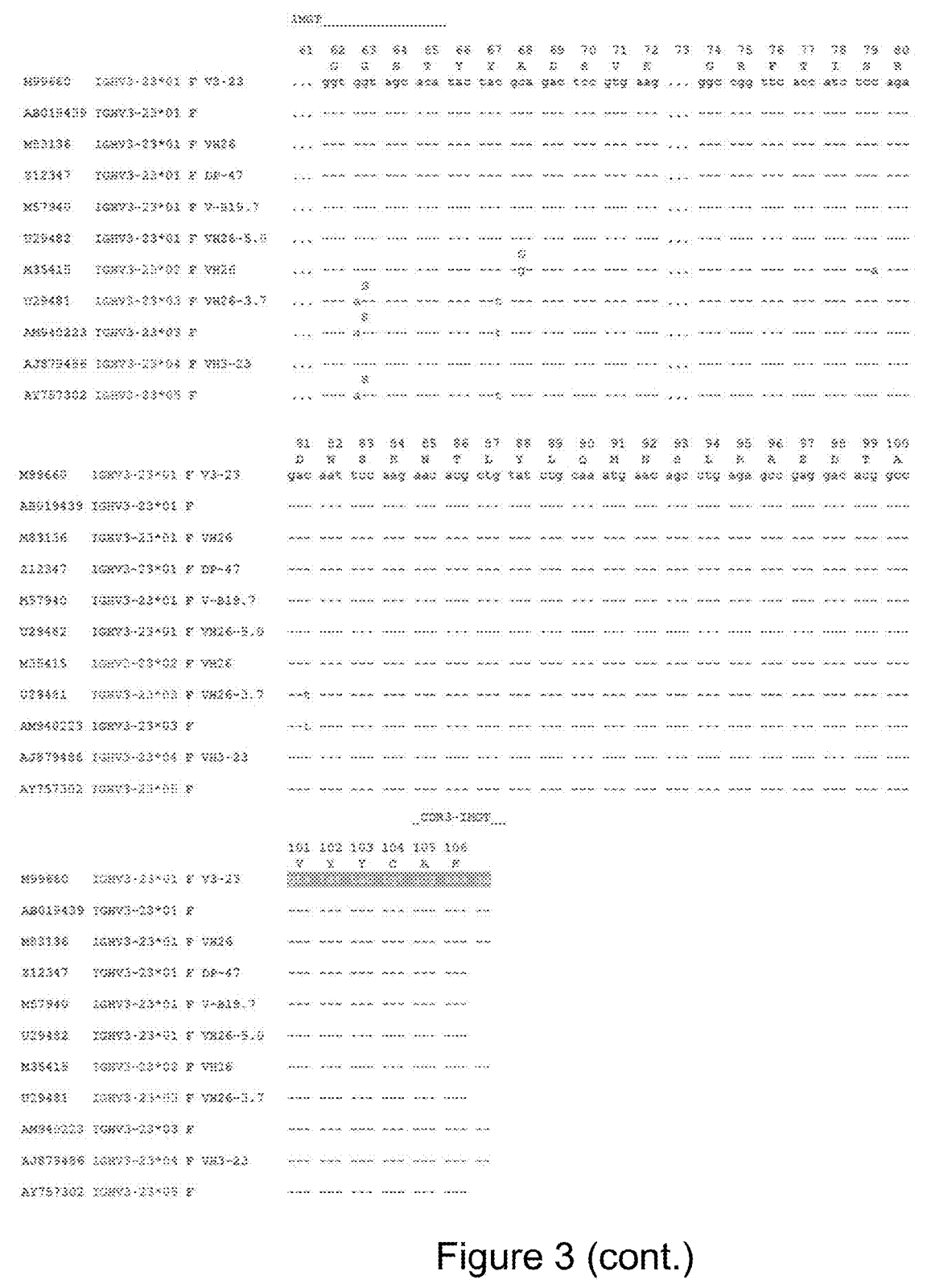

As used herein, "VH3-23*04" refers to a human VH domain variant comprising the polypeptide sequence of SEQ ID NO: 38. As opposed to the reference sequence, VH3-23*04 has a valine residue instead of a leucine residue (see FIGS. 3 and 4; L24V, numbering including signal sequence; valine at position 5 shown in FIG. 4) as a result of the presence of the rs56069819 SNP in the nucleic acid sequence encoding the VH domain. As used herein, "rs56069819" refers to a mutation or variant in a VH gene segment from adenosine to cytosine (or thymine to guanine, depending upon the strand of DNA which is being read), resulting in the VH domain encoding VH3-23*04. Rs56069819 is depicted in FIG. 4 and SEQ ID NO: 39, which demonstrate the T→G mutation (it is noted that the dbSNP entry for RS5606819 depicts the other strand, which comprises the A→C mutation). Further description of VH3-23*04 can be found, e.g., in US Patent Publication 2013/0071405; which is incorporated by reference herein in its entirety.

As used herein, "determine" or "determining" refers to ascertaining, e.g., by a quantitative or qualitative analysis. As used herein, "has been determined" can refer to ascertaining on the basis of previously obtained information or simultaneously obtained information.

In some aspects of all embodiments of the invention selecting can include automation such as a computer implemented software program that upon input of the relevant data such as ethnicity or a panel of SNP data can make the determination based on the instructions set forth herein.

As used herein, "assaying" refers to assessing, evaluating, quantifying, measuring, or characterizing an analyte, e.g., measuring the level of an analyte in a sample, identifying an analyte, or detecting the presence or absence of an analyte in a sample. In some embodiments, assaying refers to detecting a presence or absence of the analyte of interest. In some embodiments, assaying refers to quantifying an amount of an analyte, e.g., providing a measure of concentration or degree of analyte abundance. In some embodiments, assaying refers to enumerating the number of molecules of analyte present in a sample and/or specimen, e.g., to determine an analyte copy number.

As used herein "multiplex" refers to the carrying out of a method or process simultaneously and in the same reaction vessel on two or more, typically three or more, different target sequences, e.g. on two or more isoforms of PCSK9, or PCSK9 and an additional target. A multiplex analysis typically includes analysis of 10-50; 10-100; 10-1000, 10-5000, 10-10000 reactions in a multiplex format, such as a multiwall, an array, or a multichannel reaction.

Often the analysis or multiplex analysis is also automated using robotics and typically software executed by a computer and may include a robotic handling of samples, automatic or robotic selection of positive or negative results, assaying for presence of absence of a target, such as a nucleic acid polymorphism or a protein variant.

The term "biological sample" or "test sample" as used herein denotes a sample taken or isolated from a biological organism, e.g., a sample from a subject. Exemplary biological samples include, but are not limited to, a biofluid sample; serum; plasma; urine; saliva; hair, epithelial cells, skin, a tumor biopsy and/or tissue sample etc. The term also includes a mixture of the above-mentioned samples. The term "test sample" or "biological sample" also includes untreated or pretreated (or pre-processed) biological samples. For the analysis of nucleic acids, the biological sample should typically comprise at least one cell comprising nucleic acids.

The test sample can be obtained by removing a sample of cells from a subject, but can also be accomplished by using previously isolated cells (e.g. isolated at a prior time point and isolated by the same or another person). In addition, the test sample can be freshly collected or a previously collected, refrigerated, frozen or otherwise preserved sample.

In some embodiments, the test sample can be an untreated test sample. As used herein, the phrase "untreated test sample" refers to a test sample that has not had any prior sample pre-treatment except for dilution and/or suspension in a solution. Exemplary methods for treating a test sample include, but are not limited to, centrifugation, filtration, sonication, homogenization, heating, freezing and thawing, and combinations thereof. In some embodiments, the test sample can be a frozen test sample, e.g., a frozen tissue. The frozen sample can be thawed before employing methods, assays and systems described herein. After thawing, a frozen sample can be centrifuged before being subjected to methods, assays and systems described herein. In some embodiments, the test sample is a clarified test sample, for example, by centrifugation and collection of a supernatant comprising the clarified test sample. In some embodiments, a test sample can be a pre-processed test sample, for example, supernatant or filtrate resulting from a treatment selected from the group consisting of centrifugation, filtration, thawing, purification, and any combinations thereof. In some embodiments, the test sample can be treated with a chemical and/or biological reagent. Chemical and/or biological reagents can be employed to protect and/or maintain the stability of the sample, including biomolecules (e.g., nucleic acid and protein) therein, during processing. One exemplary reagent is a protease inhibitor, which is generally used to protect or maintain the stability of protein during processing. The skilled artisan is well aware of methods and processes appropriate for pre-processing of biological samples required for determination of the level of an expression product as described herein.

As used herein, "genotyping" refers to a process of determining the specific allelic composition of a cell and/or subject at one or more position within the genome, e.g. by determining the nucleic acid sequence at that position. Genotyping refers to a nucleic acid analysis and/or analysis at the nucleic acid level. As used herein, "phenotyping" refers a process of determining the identity and/or composition of an expression product of a cell and/or subject, e.g. by determining the polypeptide sequence of an expression product. Phenotyping refers to a protein analysis and/or analysis at the protein level.

As used herein, the term "nucleic acid amplification" refers to the production of additional copies of a nucleic acid sequence and is typically carried out using polymerase chain reaction (PCR) or ligase chain reaction (LCR) technologies well known in the art (Dieffenbach, C. W. and G. S. Dveksler (1995) PCR Primer, a Laboratory Manual, Cold Spring Harbor Press, Plainview, N.Y.). Other methods for amplification are also contemplated in aspects of the invention.

The term "allele-specific amplification" refers to a reaction (e.g., PCR reaction) in which at least one of the primers (e.g., allele-specific primer) is chosen from a polymorphic area of a gene (e.g., single nucleotide polymorphism), with the polymorphism located at or near the primer's 3'-end. A mismatched primer will not initiate amplification, whereas a matched primer will initiate amplification. The appearance of an amplification product is indicative of the presence of the polymorphism.

As used herein, "sequencing" refers to the determination of the exact order of nucleotide bases in a strand of DNA (deoxyribonucleic acid) or RNA (ribonucleic acid) or the exact order of amino acids residues or peptides in a protein. Nucleic acid sequencing can be done using Sanger sequencing or next-generation high-throughput sequencing.

As used herein "next-generation sequencing" refers to oligonucleotide sequencing technologies that have the capacity to sequence oligonucleotides at speeds above those possible with conventional sequencing methods (e.g. Sanger sequencing), due to performing and reading out thousands to millions of sequencing reactions in parallel. Non-limiting examples of next-generation sequencing methods/platforms include Massively Parallel Signature Sequencing (Lynx Therapeutics); 454 pyro-sequencing (454 Life Sciences/Roche Diagnostics); solid-phase, reversible dye-terminator sequencing (Solexa/Illumina): SOLiD technology (Applied Biosystems); Ion semiconductor sequencing (ION Torrent); DNA nanoball sequencing (Complete Genomics); and technologies available from Pacific Biosciences, Intelligen Bio-systems, Oxford Nanopore Technologies, and Helicos Biosciences. Next-generation sequencing technologies and the constraints and design parameters of associated sequencing primers are well known in the art (see, e.g. Shendure, et al., "Next-generation DNA sequencing," Nature, 2008, vol. 26, No. 10, 1135-1145; Mardis, "The impact of next-generation sequencing technology on genetics," Trends in Genetics, 2007, vol. 24, No. 3, pp. 133-141; Su, et al., "Next-generation sequencing and its applications in molecular diagnostics" Expert Rev Mol Diagn, 2011, 11(3):333-43; Zhang et al., "The impact of next-generation sequencing on genomics", J Genet Genomics, 2011, 38(3):95-109; (Nyren, P. et al. Anal Biochem 208: 17175 (1993); Bentley, D. R. Curr Opin Genet Dev 16:545-52 (2006); Strausberg, R. L., et al. Drug Disc Today 13:569-77 (2008); U.S. Pat. No. 7,282,337; U.S. Pat. No. 7,279,563; U.S. Pat. No. 7,226,720; U.S. Pat. No. 7,220,549; U.S. Pat. No. 7,169,560; U.S. Pat. No. 6,818,395; U.S. Pat. No. 6,911,345; US Pub. Nos. 2006/0252077; 2007/0070349; and 20070070349; which are incorporated by referene herein in their entireties).

As used herein, "nucleic acid hybridization" refers to the pairing of complementary RNA and DNA strands as well as the pairing of complementary DNA single strands. In some embodiments, nucleic acid hybridization can refer to a method of determining a nucleic acid sequence and/or identity by hybridizing a nucleic acid sample with a probe, e.g. Northern or Southern blot analysis or microarray analysis.

As used herein, the terms "treat" "treatment" "treating," or "amelioration" refer to therapeutic treatments, wherein the object is to reverse, alleviate, ameliorate, inhibit, slow down or stop the progression or severity of a condition associated with a disease or disorder. The term "treating" includes reducing or alleviating at least one adverse effect or symptom of a condition, disease or disorder. Treatment is generally "effective" if one or more symptoms or clinical markers are reduced. Alternatively, treatment is "effective" if the progression of a disease is reduced or halted. That is, "treatment" includes not just the improvement of symptoms or markers, but also a cessation of, or at least slowing of, progress or worsening of symptoms compared to what would be expected in the absence of treatment. Beneficial or desired clinical results include, but are not limited to, alleviation of one or more symptom(s), diminishment of extent of disease, stabilized (i.e., not worsening) state of disease, delay or slowing of disease progression, amelioration or palliation of the disease state, remission (whether partial or total), and/or decreased mortality, whether detectable or undetectable. The term "treatment" of a disease also includes providing relief from the symptoms or side-effects of the disease (including palliative treatment). For treatment to be effective a complete cure is not contemplated. The method can in certain aspects include cure as well.

As used herein, the term "pharmaceutical composition" refers to the active agent in combination with a pharmaceutically acceptable carrier e.g. a carrier commonly used in the pharmaceutical industry. The phrase "pharmaceutically acceptable" is employed herein to refer to those compounds, materials, compositions, and/or dosage forms which are, within the scope of sound medical judgment, suitable for use in contact with the tissues of human beings and animals without excessive toxicity, irritation, allergic response, or other problem or complication, commensurate with a reasonable benefit/risk ratio.

As used herein, the term "administering," refers to the placement of a compound as disclosed herein into a subject by a method or route which results in at least partial delivery of the agent at a desired site. Pharmaceutical compositions comprising the compounds disclosed herein can be administered by any appropriate route which results in an effective treatment in the subject.

Multiple compositions can be administered separately or simultaneously. Separate administration refers to the two compositions being administered at different times, e.g. at least 10, 20, 30, or 10-60 minutes apart, or 1, 2, 3, 4, 5, 6, 7, 8, 9, 10, 12 hours apart. One can also administer compositions at 24 hours apart, or even longer apart. Alternatively, two or more compositions can be administered simultaneously, e.g. less than 10 or less than 5 minutes apart. Compositions administered simultaneously can, in some aspects, be administered as a mixture, with or without similar or different time release mechanism for each of the components.

As used herein, "contacting" refers to any suitable means for delivering, or exposing, an agent to at least one complex, enzyme, or cell. Exemplary delivery methods include, but are not limited to, direct delivery to cell culture medium, perfusion, injection, or other delivery method well known to one skilled in the art.

As used herein, "obtain" refers to any method of acquiring, securing, procuring, or coming into the possession of, e.g. a sample. Obtaining a biological sample from a subject can comprise physical removing a sample from a subject (e.g. drawing blood or taking a hair or saliva sample) without or without active participation from the subject; receiving a sample from a subject (e.g. the subject collects a saliva or hair sample themselves and provides it, e.g. in a container provided for the purpose); or procuring a sample from a storage facility, medical facility, or medical provider. Obtain from the human or subject, refers to an active step of, e.g., drawing blood or taking a tissue or cell sample.

As used herein, "cholesterol level" refers to a level of one or more of total cholesterol, LDL cholesterol, HDL cholesterol, and/or triglycerides. Cholesterol levels can be the level of cholesterol in the blood of a subject.

As used herein in reference to cholesterol levels, "maintain" refers to preventing the level from worsening (e.g. increasing). In some embodiments, maintaining a particular level refers to a process that results in the cholesterol level not increasing by more than 10% over time. Maintaining may also refer to maintaining a previously achieved level. For example, if a human has received statin treatment, one can maintain the cholesterol level achieved using the statin treatment.

In some embodiments, the subject treated according to the methods described herein has previously had their cholesterol level reduced. As used herein, "previously reduced" indicates that at a prior point in time, the subject experienced a decrease in cholesterol levels. The decrease can be due to administration of a pharmaceutical composition (e.g. administration of a composition as described herein or another composition, e.g. a statin) or due to another cause, e.g. a change in diet and/or exercise.

An existing treatment for high cholesterol levels is the administration of a statin. As referred to herein, a "statin" (also known as HMG-CoA reductase inhibitors) are inhibitors of the enzyme HMG-coA reductase, which mediates cholesterol production in the liver. Statins, by competitively binding HMG-CoA reductase, prevent the binding of HMG-CoA to the enzyme and thereby inhibit the activity of the reductase (e.g. the production of mevalonate). Non-limiting examples of statins can include atorvastatin (LIPITOR™), fluvastatin (LESCOL™), lovastatin (MEVACOR™, ALTOCOR™), pitavastatin (LIVALO™), pravastatin (PRAVACHOL™) rosuvastatin (CRESTOR™), and simvastatin (ZOCOR™). Statins can be administered in combination with other agents, e.g. the combination of ezetimibe and simvastatin.

Some subjects are, or become, resistant to statin treatment. As used herein, "resistant to statin treatment" or "reduced responsiveness to statin treatment" refers to a subject exhibiting a statistically significantly lower response to the administration of a statin as compared to a reference level. The reference level can be, e.g., the average response for a population of subjects or the level of the individual subject at an earlier date. A response to statin treatment is readily measured by one of skill in the art, e.g., measurement of cholesterol levels, changes in cholesterol levels, and/or HMG-CoA reductase activity.

As used herein, the term "detectable label" refers to a molecule or moiety that can be detected, e.g. measured and/or determined to be present or absent. Detectable labels can comprise, for example, a light-absorbing dye, a fluorescent dye, or a radioactive label. Detectable labels, methods of detecting them, and methods of incorporating them into reagents (e.g. antibodies and nucleic acid probes) are well known in the art.

In some embodiments, detectable labels can include labels that can be detected by spectroscopic, photochemical, biochemical, immunochemical, electromagnetic, radiochemical, or chemical means, such as fluorescence, chemifluorescence, or chemiluminescence, or any other appropriate means. The detectable labels used in the methods described herein can be primary labels (where the label comprises a moiety that is directly detectable or that produces a directly detectable moiety) or secondary labels (where the detectable label binds to another moiety to produce a detectable signal, e.g., as is common in immunological labeling using secondary and tertiary antibodies). The detectable label can be linked by covalent or non-covalent means to the reagent. Alternatively, a detectable label can be linked such as by directly labeling a molecule that achieves binding to the reagent via a ligand-receptor binding pair arrangement or other such specific recognition molecules. Detectable labels can include, but are not limited to radioisotopes, bioluminescent compounds, chromophores, antibodies, chemiluminescent compounds, fluorescent compounds, metal chelates, and enzymes.

In other embodiments, the detectable label can be a fluorescent compound. When the fluorescently label is exposed to light of the proper wavelength, its presence can then be detected due to fluorescence. In some embodiments, a detectable label can be a fluorescent dye molecule, or fluorophore including, but not limited to fluorescein, phycoerythrin, phycocyanin, o-phthaldehyde, fluorescamine, Cy3™, Cy5™, allophycocyanine, Texas Red, peridenin chlorophyll, cyanine, tandem conjugates such as phycoerythrin-Cy5™, green fluorescent protein, rhodamine, fluorescein isothiocyanate (FITC) and Oregon Green™, rhodamine and derivatives (e.g., Texas red and tetrarhodimine isothiocynate (TRITC)), biotin, phycoerythrin, AMCA, CyDyes™, 6-carboxyfhiorescein (commonly known by the abbreviations FAM and F), 6-carboxy-2',4',7',4,7-hexachlorofiuorescein (HEX), 6-carboxy-4',5'-dichloro-2',7'-dimethoxyfluorescein (JOE or J), N,N,N',N'-tetramethyl-6carboxyrhodamine (TAMRA or T), 6-carboxy-X-rhodamine (ROX or R), 5-carboxyrhodamine-6G (R6G5 or G5), 6-carboxyrhodamine-6G (R6G6 or G6), and rhodamine 110; cyanine dyes, e.g. Cy3, Cy5 and Cy7 dyes; coumarins, e.g umbelliferone; benzimide dyes, e.g. Hoechst 33258; phenanthridine dyes, e.g. Texas Red; ethidium dyes; acridine dyes; carbazole dyes; phenoxazine dyes; porphyrin dyes; polymethine dyes, e.g. cyanine dyes such as Cy3, Cy5, etc; BODIPY dyes and quinoline dyes. In some embodiments, a detectable label can be a radiolabel including, but not limited to $^3H$, $^{125}I$ $^{35}S$, $^{14}C$, $^{32}P$, and $^{33}P$. In some embodiments, a detectable label can be an enzyme including, but not limited to horseradish peroxidase and alkaline phosphatase. An enzymatic label can produce, for example, a chemiluminescent signal, a color signal, or a fluorescent signal. Enzymes contemplated for use as a detectable label can include, but are not limited to, malate dehydrogenase, staphylococcal nuclease, delta-V-steroid isomerase, yeast alcohol dehydrogenase, alpha-glycerophosphate dehydrogenase, triose phosphate isomerase, horseradish peroxidase, alkaline phosphatase, asparaginase, glucose oxidase, beta-galactosidase, ribonuclease, urease, catalase, glucose-VI-phosphate dehydrogenase, glucoamylase and acetylcholinesterase. In some embodiments, a detectable label is a chemiluminescent label, including, but not limited to lucigenin, luminol, luciferin, isoluminol, theromatic acridinium ester, imidazole, acridinium salt and oxalate ester. In some embodiments, a detectable label can be a spectral colorimetric label including, but not limited to colloidal gold or colored glass or plastic (e.g., polystyrene, polypropylene, and latex) beads.

In some embodiments, reagents can also be labeled with a detectable tag, such as c-Myc, HA, VSV-G, HSV, FLAG, V5, HIS, or biotin. Other detection systems can also be used, for example, a biotin-streptavidin system. In this system, the antibodies immunoreactive (i. e. specific for) with the biomarker of interest is biotinylated. Quantity of biotinylated antibody bound to the biomarker is determined using a streptavidin-peroxidase conjugate and a chromagenic substrate. Such streptavidin peroxidase detection kits are commercially available, e. g. from DAKO; Carpinteria, Calif. A reagent can also be detectably labeled using fluorescence emitting metals such as $^{152}Eu$, or others of the lanthanide series. These metals can be attached to the reagent using such metal chelating groups as diethylenetriaminepentaacetic acid (DTPA) or ethylenediaminetetraacetic acid (EDTA).

As used herein, "authorization number" or "marketing authorization number" refers to a number issued by a regulatory agency upon that agency determining that a particular medical product and/or composition may be marketed and/or offered for sale in the area under the agency's jurisdiction. As used herein "regulatory agency" refers to one of the agencies responsible for evaluating, e.g, the safety and efficacy of a medical product and/or composition and controlling the sales/marketing of such products and/or compositions in a given area. The Food and Drug Administration (FDA) in the US and the European Medicines Agency (EPA) in Europe are but two examples of such regulatory agencies. Other non-limiting examples can include SDA, MPA, MHPRA, IMA, ANMAT, Hong Kong Department of Health-Drug Office, CDSCO, Medsafe, and KFDA.

As used herein, "injection device" refers to a device that is designed for carrying out injections, an injection including the steps of temporarily fluidically coupling the injection device to a person's tissue, typically the subcutaneous tissue. An injection further includes administering an amount of liquid drug into the tissue and decoupling or removing the injection device from the tissue. In some embodiments, an injection device can be an intravenous device or IV device, which is a type of injection device used when the target tissue is the blood within the circulatory system, e.g., the blood in a vein. A common, but non-limiting example injection device is a needle and syringe.

As used herein, a "buffer" refers to a chemical agent that is able to absorb a certain quantity of acid or base without undergoing a strong variation in pH.

As used herein, "packaging" refers to how the components are organized and/or restrained into a unit fit for distribution and/or use. Packaging can include, e.g., boxes, bags, syringes, ampoules, vials, tubes, clamshell packaging, barriers and/or containers to maintain sterility, labeling, etc.

As used herein, "instructions" refers to a display of written, printed or graphic matter on the immediate container of an article, for example the written material displayed on a vial containing a pharmaceutically active agent, or details on the composition and use of a product of interest included in a kit containing a composition of interest. Instructions set forth the method of the treatment as contemplated to be administered or performed.

As used herein, a "solid surface" refers to an object suitable for the attachment of biomolecules. Non-limiting examples of a solid surface can include a particle (including, but not limited to an agarose or latex bead or particle or a magnetic particle), a bead, a nanoparticle, a polymer, a substrate, a slide, a coverslip, a plate, a dish, a well, a membrane, and/or a grating. The solid surface can include many different materials including, but not limited to, polymers, plastics, resins, polysaccharides, silicon or silica based materials, carbon, metals, inorganic glasses, and membranes.

As used herein, "classification" of a subject, e.g., classification of the subject's ancestry refers to determining if the subject has biological ancestors who originated in a particular geographical area, and are therefore likely to have particular genetic variants found in the populations which have historically occupied that area. Classification can comprise, e.g. obtaining information on the subject's family, interviewing the subject or a family member regarding their biological family's ancestry, and/or genetic testing. Classification can be on the basis used for the 1000 Genomes Project, as will be familiar to the skilled person in the art. In some embodiments, the subject can be classified as being of a particular ancestry if at least the subject's genome comprises a substantial number of different alleles in common with other humans of that ancestry (eg, determined by reference to the 1000 Genomes Project database), for example, at least 10, 20, 30, 40, 50 or 100 or more alleles in common Abbreviations for particular ancestral groups are provided in Table 4.

The term "statistically significant" or "significantly" refers to statistical significance and generally means a two standard deviation (2SD) or greater difference.

Other than in the operating examples, or where otherwise indicated, all numbers expressing quantities of ingredients or reaction conditions used herein should be understood as modified in all instances by the term "about." The term "about" when used in connection with percentages can mean±1%.

As used herein the term "comprising" or "comprises" is used in reference to compositions, methods, and respective component(s) thereof, that are essential to the method or composition, yet open to the inclusion of unspecified elements, whether essential or not.

The term "consisting of" refers to compositions, methods, and respective components thereof as described herein, which are exclusive of any element not recited in that description of the embodiment.

As used herein the term "consisting essentially of" refers to those elements required for a given embodiment. The term permits the presence of elements that do not materially affect the basic and novel or functional characteristic(s) of that embodiment.

The singular terms "a," "an," and "the" include plural referents unless context clearly indicates otherwise. Similarly, the word "or" is intended to include "and" unless the context clearly indicates otherwise. Although methods and materials similar or equivalent to those described herein can be used in the practice or testing of this disclosure, suitable methods and materials are described below. The abbreviation, "e.g." is derived from the Latin exempli gratia, and is used herein to indicate a non-limiting example. Thus, the abbreviation "e.g." is synonymous with the term "for example."

Definitions of common terms in cell biology and molecular biology can be found in "The Merck Manual of Diagnosis and Therapy", 19th Edition, published by Merck Research Laboratories, 2006 (ISBN 0-911910-19-0); Robert S. Porter et al. (eds.), The Encyclopedia of Molecular Biology, published by Blackwell Science Ltd., 1994 (ISBN 0-632-02182-9); Benjamin Lewin, Genes X, published by Jones & Bartlett Publishing, 2009 (ISBN-10: 0763766321); Kendrew et al. (eds.), Molecular Biology and Biotechnology: a Comprehensive Desk Reference, published by VCH Publishers, Inc., 1995 (ISBN 1-56081-569-8) and Current Protocols in Protein Sciences 2009, Wiley Intersciences, Coligan et al., eds.

Unless otherwise stated, the present invention was performed using standard procedures, as described, for example in Sambrook et al., Molecular Cloning: A Laboratory Manual (4 ed.), Cold Spring Harbor Laboratory Press, Cold Spring Harbor, N.Y., USA (2012); Davis et al., Basic Methods in Molecular Biology, Elsevier Science Publishing, Inc., New York, USA (1995); or Methods in Enzymology: Guide to Molecular Cloning Techniques Vol. 152, S. L. Berger and A. R. Kimmel Eds., Academic Press Inc., San Diego, USA (1987); Current Protocols in Protein Science (CPPS) (John E. Coligan, et. al., ed., John Wiley and Sons, Inc.), Current Protocols in Cell Biology (CPCB) (Juan S. Bonifacino et. al. ed., John Wiley and Sons, Inc.), and Culture of Animal Cells: A Manual of Basic Technique by R. Ian Freshney, Publisher: Wiley-Liss; 5th edition (2005), Animal Cell Culture Methods (Methods in Cell Biology, Vol. 57, Jennie P. Mather and David Barnes editors, Academic Press, 1st edition, 1998) which are all incorporated by reference herein in their entireties.

Other terms are defined herein within the description of the various aspects of the invention.

All patents and other publications; including literature references, issued patents, published patent applications, and co-pending patent applications; cited throughout this application are expressly incorporated herein by reference for the purpose of describing and disclosing, for example, the methodologies described in such publications that might be used in connection with the technology described herein. These publications are provided solely for their disclosure prior to the filing date of the present application. Nothing in this regard should be construed as an admission that the inventors are not entitled to antedate such disclosure by virtue of prior invention or for any other reason. All statements as to the date or representation as to the contents of these documents is based on the information available to the applicants and does not constitute any admission as to the correctness of the dates or contents of these documents.

The description of embodiments of the disclosure is not intended to be exhaustive or to limit the disclosure to the precise form disclosed. While specific embodiments of, and examples for, the disclosure are described herein for illustrative purposes, various equivalent modifications are possible within the scope of the disclosure, as those skilled in the relevant art will recognize. For example, while method steps or functions are presented in a given order, alternative embodiments may perform functions in a different order, or functions may be performed substantially concurrently. The teachings of the disclosure provided herein can be applied to other procedures or methods as appropriate. The various embodiments described herein can be combined to provide further embodiments. Aspects of the disclosure can be modified, if necessary, to employ the compositions, functions and concepts of the above references and application to provide yet further embodiments of the disclosure. Moreover, due to biological functional equivalency considerations, some changes can be made in protein structure without affecting the biological or chemical action in kind or amount. These and other changes can be made to the disclosure in light of the detailed description. All such modifications are intended to be included within the scope of the appended claims.

Specific elements of any of the foregoing embodiments can be combined or substituted for elements in other embodiments. Furthermore, while advantages associated with certain embodiments of the disclosure have been described in the context of these embodiments, other embodiments may also exhibit such advantages, and not all embodiments need necessarily exhibit such advantages to fall within the scope of the disclosure.

It will be understood that particular configurations, aspects, examples, clauses and embodiments described herein are shown by way of illustration and not as limitations of the invention. The principal features of this invention can be employed in various embodiments without departing from the scope of the invention. Those skilled in the art will recognize, or be able to ascertain using no more than routine study, numerous equivalents to the specific procedures described herein. Such equivalents are considered to be within the scope of this invention and are covered by the claims. All publications and patent applications mentioned in the specification are indicative of the level of skill of those skilled in the art to which this invention pertains. All publications and patent applications are herein incorporated by reference to the same extent as if each individual publication or patent application was specifically and individually indicated to be incorporated by reference. The use of the word "a" or "an" when used in conjunction with the term "comprising" in the claims and/or the specification may mean "one," but it is also consistent with the meaning of "one or more," "at least one," and "one or more than one." The use of the term "or" in the claims is used to mean "and/or" unless explicitly indicated to refer to alternatives only or the alternatives are mutually exclusive, although the disclosure supports a definition that refers to only alternatives and "and/or." Throughout this application, the term "about" is used to indicate that a value includes the inherent variation of error for the device, the method being employed to determine the value, or the variation that exists among the study subjects.

As used in this specification and claim(s), the words "comprising" (and any form of comprising, such as "comprise" and "comprises"), "having" (and any form of having, such as "have" and "has"), "including" (and any form of including, such as "includes" and "include") or "containing" (and any form of containing, such as "contains" and "contain") are inclusive or open-ended and do not exclude additional, unrecited elements or method steps Any part of this disclosure may be read in combination with any other part of the disclosure, unless otherwise apparent from the context.

References to sequences by "SEQ ID NO:" herein (eg, in the claims) is by reference to the sequences appearing in the Tables; similarly refrence to position numbers "in SEQ ID NO:" (eg, in the claims) is by reference to the sequences appearing in the Tables herein (eg, as per Tables 6, 10 and 17). Thus, for example, "an Asp corresponding to position 204 of SEQ ID NO: 42 or a Leu corresponding to position 206 of SEQ ID NO: 42" refers to the Asp and Leu labelled as being at positions 204 and 206 respectively of SEQ ID NO: 42 shown in Table 10 herein.

All of the compositions and/or methods disclosed and claimed herein can be made and executed without undue experimentation in light of the present disclosure. While the compositions and methods of this invention have been described in terms of preferred embodiments, it will be apparent to those of skill in the art that variations may be applied to the compositions and/or methods and in the steps or in the sequence of steps of the method described herein without departing from the concept, spirit and scope of the invention. All such similar substitutes and modifications apparent to those skilled in the art are deemed to be within the spirit, scope and concept of the invention as defined by the appended claims.

The present invention is described in more detail in the following non limiting Examples.

Some embodiments of the technology described herein can be defined according to any of the following numbered paragraphs:

1. A method of treating or preventing a disease or condition in a human, wherein the disease or condition is mediated by a Target of Interest (TOI), wherein the TOI is present in humans as different polymorphic variants, the method comprising
    a. selecting a human that is positive for the TOI polymorphic variant, wherein the TOI in said human is encoded by a nucleotide sequence comprising an allele having a cumulative human allele frequency of less than 50% and/or wherein the TOI in said human is encoded by a nucleotide sequence comprising an allele having total human genotype frequency of less than 50%; and b. administering to the human an anti-TOI ligand to target the TOI in the human to treat or prevent said disease or condition.

In a first alternative, paragraph 1 provides:—

A method of treating or preventing a disease or condition in a human, wherein the disease or condition is mediated by a Target of Interest (TOI), wherein the TOI is present in humans as different polymorphic variants, the method comprising administering to said human an anti-TOI ligand (eg, an antibody or antibody fragment) that specifically binds a TOI variant that is encoded by a nucleotide sequence comprising a SNP having a cumulative human allele frequency of less than 50% (eg, less than 40, 35, 30, 35, 20, 15, 10, 5, 4, 3, 2, or 1%) and/or wherein the TOI variant is encoded by a nucleotide sequence comprising a SNP having total human genotype frequency of less than 50% (eg, less than 40, 35, 30, 35, 20, 15, 10, 5, 4, 3, 2, or 1%); wherein the human comprises a (eg, said) TOI-encoding nucleotide sequence comprising said SNP; wherein (i) the ligand (eg, antibody or fragment) comprises a VH domain derived from the recombination of a human VH segment, a human D gene segment and a human JH segment, the human VH segment comprising a SNP, and wherein the human comprises a (eg, said) VH segment comprising said SNP; or (ii) the ligand (eg, antibody or fragment) comprises a Vλ domain derived from the recombination of a human Vλ segment and a human Jλ segment, the human Vλ segment comprising a SNP, and wherein the human comprises a (eg, said) Vλ segment comprising said SNP; or (iii) the ligand (eg, antibody or fragment) comprises a Vκ domain derived from the recombination of a human Vκ segment and a human Jκ segment, the human Vκ segment comprising a SNP, and wherein the human comprises a (eg, said) Vκ segment comprising said SNP; or (iv) the ligand (eg, antibody or fragment) comprises a heavy chain constant region (eg, a gamma-1, 2, 3 o 4 constant region) encoded by a nucleotide sequence comprising a SNP, and wherein the human comprises a (eg, said) heavy chain constant region (eg, a gamma-1, 2, 3 o 4 constant region respectively) comprising said SNP; or (v) the ligand (eg, antibody or fragment) comprises a lambda chain constant encoded by a nucleotide sequence comprising a SNP, and wherein the human comprises a (eg, said) lambda chain constant region comprising said SNP; or (vi) the ligand (eg, antibody or fragment) comprises a kappa chain constant encoded by a nucleotide sequence comprising a SNP, and wherein the human comprises a (eg, said) kappa chain constant region comprising said SNP.

In a second alternative, paragraph 1 provides:—

A method of treating or preventing a disease or condition in a human, wherein the disease or condition is mediated by a Target of Interest (TOI), wherein the TOI is present in humans as different polymorphic variants, the method comprising administering to said human an anti-TOI ligand (eg, an antibody or antibody fragment) that specifically binds a TOI variant that comprises a single amino acid variation (ie, a single amino acid at a position where there is difference between TOI variants in humans) having a cumulative human allele frequency of less than 50% (eg, less than 40, 35, 30, 35, 20, 15, 10, 5, 4, 3, 2, or 1%) and/or wherein the amino acid variant has a total human genotype frequency of less than 50% (eg, less than 40, 35, 30, 35, 20, 15, 10, 5, 4, 3, 2, or 1%); wherein the human expresses TOI proteins comprising said single amino acid variation; wherein (i) the ligand (eg, antibody or fragment) comprises a VH domain comprising the same single amino acid variation, and wherein the human expresses VH domains comprising said single amino acid variation; or (ii) the ligand (eg, antibody or fragment) comprises a Vλ domain comprising a single amino acid variation, and wherein the human expresses Vλ domains comprising the same single amino acid variation; or (iii) the ligand (eg, antibody or fragment) comprises a Vκ domain comprising a single amino acid variation, and wherein the human expresses Vκ domains comprising the same single amino acid variation; or (iv) the ligand (eg, antibody or fragment) comprises a heavy chain constant region (eg, a gamma-1, 2, 3 o 4 constant region, eg, wherein the constant region is an Fc, CH1, CH2 or CH3) comprising a single amino acid variation, and wherein the human expresses a heavy chain constant region (eg, a gamma-1, 2, 3 o 4 constant region, eg, wherein the constant region is an Fc, CH1, CH2 or CH3 respectively) comprising the same single amino acid variation; or (v) the ligand (eg, antibody or fragment) comprises a lambda chain constant region comprising a single amino acid variation, and wherein the human expresses a lambda chain constant region comprising the same single amino acid variation; or (vi) the ligand (eg, antibody or fragment) comprises a kappa chain constant region comprising a single amino acid variation, and wherein the human expresses a kappa chain constant region comprising the same single amino acid variation.

The term "comprises a single amino acid variation" includes the possibility of there being further amino acid variations in the TOI sequence.

In an example, frequencies herein are according to the 1000 Genomes database, eg, the Phase I database or as shown in Ensembl (available on the world wide web at ensembl.org), eg, at 1 Oct. 2013 or 1 Oct. 2014.

In an example, each SNP encodes a non-synonymous amino acid variation, ie, the SNP is not a silent mutation.

Optionally, the method comprises selecting said human comprising the nucleotide sequence prior to administration.

In a third alternative where the TOI is human PCSK9, paragraph 1 provides:—

A method of reducing cholesterol level or maintaining previously reduced cholesterol level in a human in need thereof, the method comprising administering to said human an antibody or antibody fragment that specifically binds a proprotein convertase subtilisin/kexin type 9 (PCSK9) that comprises a C-terminal domain comprising a mutation as defined herein (eg, I474V or E670G) in SEQ ID NO: 1, wherein the antibody comprises a VH domain derived from the recombination of a human VH segment, a human D gene segment and a human JH segment, the human VH segment encoding a valine at the amino acid corresponding to position 5 of SEQ ID NO: 40 and wherein said human comprises (i) a VH gene segment encoding the framework 1 of SEQ ID NO: 40 and (ii) a nucleotide sequence encoding a proprotein convertase subtilisin/kexin type 9 (PCSK9) that comprises a C-terminal domain comprising said mutation in SEQ ID NO: 1.

In a fourth alternative where the TOI is human PCSK9, paragraph 1 provides:—

A method of reducing cholesterol level or maintaining previously reduced cholesterol level in a human in need thereof, the method comprising administering to said human an antibody or antibody fragment that specifically binds a proprotein convertase subtilisin/kexin type 9 (PCSK9) that comprises a C-terminal domain comprising a mutation as defined herein (eg, I474V or E670G) in SEQ ID NO: 1, wherein the antibody comprises a VL domain derived from the recombination of a human VL segment and a human JL segment, the human VL segment is a Vλ or Vκ disclosed herein and wherein said human comprises (i) said VL gene segment and (ii) a nucleotide sequence encoding a proprotein convertase subtilisin/kexin type 9 (PCSK9) that comprises a C-terminal domain comprising said mutation in SEQ ID NO: 1.

In a fifth alternative where the TOI is human PCSK9, paragraph 1 provides:—

A method of reducing cholesterol level or maintaining previously reduced cholesterol level in a human in need thereof, the method comprising administering to said human an antibody or antibody fragment that specifically binds a proprotein convertase subtilisin/kexin type 9 (PCSK9) that comprises a C-terminal domain comprising a mutation as defined herein (eg, I474V or E670G) in SEQ ID NO: 1, wherein the antibody comprises a C domain encoded by a human CH, Cλ or Cκ gene segment disclosed herein and wherein said human comprises (i) said C gene segment and (ii) a nucleotide sequence encoding a proprotein convertase subtilisin/kexin type 9 (PCSK9) that comprises a C-terminal domain comprising said mutation in SEQ ID NO: 1.

The following paragraphs 2-8, 19 and 49 onwards relate to any of the alternatives of paragraph 1.

2. The method of paragraph 1, wherein before step (a) the ligand has been or is determined as being capable of specifically binding to said TOI variant.
3. The method of paragraph 1 or 2, comprising determining that the human is positive for the TOI polymorphic variant, optionally wherein the step of determining comprises determining that the human is positive for a nucleotide variant encoding said TOI variant.
4. The method of paragraph 3, wherein the step of determining comprises assaying a biological sample obtained from said human for a nucleotide polymorphism encoding said TOI polymorphic variant.
5. The method of paragraph 3 or 4, wherein the step of determining comprises assaying a biological sample obtained from said human for a protein corresponding to the TOI polymorphic variant.
6. The method of any preceding paragraph, wherein said frequency is less than 15%.
7. The method of any preceding paragraph, wherein said frequency is less than 10%.
8. The method of any preceding paragraph, wherein the ligand is capable of specifically binding to two or more different TOI variants, each being encoded by a nucleotide sequence comprising an allele having a cumulative human allele frequency of less than 50% and/or having a total human genotype frequency of less than 50%.
9. A method of treating or preventing a disease or condition in a human, wherein the disease or condition is mediated by a Target of Interest (TOI), wherein the TOI is present in humans as different polymorphic variants, the method comprising
   a. selecting a human that is negative for a variant nucleotide sequence comprising an allele having a cumulative human allele frequency of less than 50% and/or having a total human genotype frequency of less than 50%; or that the human is negative for a TOI variant encoded by a nucleotide sequence comprising the allele having a cumulative human allele frequency of less than 50% and/or having a total human genotype frequency of less than 50%; and
   b. administering to the human an anti-TOI ligand to target the TOI variant in the human and treat or prevent said disease or condition, wherein the TOI in said human is a variant encoded by a nucleotide sequence comprising an allele having a cumulative human allele frequency of more than 50% and/or having a total human genotype frequency of more than 50%.
10. The method of paragraph 9, comprising determining that the human is positive for the TOI polymorphic variant, optionally wherein the determining comprises that the human has been or is phenotyped as positive for the most frequent TOI variant or genotyped for the nucleotide sequence thereof.
11. The method of paragraph 10, wherein determining comprises assaying for the nucleotide sequence to determine the presence of said allele.
12. The method of paragraph 11, wherein the assaying comprises nucleic acid amplification.
13. The method of paragraph 11 or 12, wherein the assaying comprises hybridization, sequencing, or next generation sequencing.
14. The method of any of paragraphs 11-13, further comprising the step of obtaining a biological sample from the human.
15. The method of any one of paragraphs 9-14, wherein the ligand has been or is determined as being capable of specifically binding to the most frequent TOI variant.
16. The method of any one of paragraphs 9-15, wherein the ligand has been or is determined as being substantially incapable of neutralising or inhibiting said TOI variant.
17. The method of any one of paragraphs 9-16, wherein the ligand is capable of specifically binding to the most frequent TOI variant.
18. The method of any one of paragraphs 9-17, wherein the ligand is capable of specifically binding to two or more different TOI variants, each being encoded by a nucleotide sequence comprising an allele having a cumulative human allele frequency of more than 50%.
19. The method of any preceding paragraph, wherein said TOI polymorphic variant has been or is determined as being present in at least two different human ethnic populations.
20. The method of any preceding paragraph, wherein said cumulative human allele frequency is the frequency in a database of naturally-occurring sequences sampled from at least 15 different human ethnic populations and comprising at least 1000 sequences.
21. The method of any of the preceding paragraphs, wherein the ligand is an antibody, antibody fragment or an affibody.
22. The method of any of the preceding paragraphs, wherein the ligand comprises a nucleotide sequence that specifically hybridises to a TOI nucleotide sequence comprising an allele having a cumulative human allele frequency of less than 50% and/or having a total human genotype frequency of less than 50% or an RNA transcript thereof; and/or the ligand comprises a nucleotide sequence that comprises at least 10 contiguous nucleotides of a nucleotide sequence having a cumulative human allele frequency of less than 50% and/or having a total human genotype frequency of less than 50% or is an antisense sequence thereof.
23. The method of any of the preceding paragraphs, wherein the genome of said human comprises an allele having a cumulative human allele frequency of less than 50% and the allele is found in at least 2 different ethnic populations.
24. A composition comprising a ligand capable of binding a target of interest encoded by a nucleotide sequence comprising an allele having a cumulative human allele frequency of less than 50% and the allele is found in at least 2 different ethnic populations and optionally a pharmaceutically acceptable carrier and optionally a label or instructions for use to treat and/or prevent said disease or condition in a human; optionally wherein the label or instructions comprise a marketing authorisation number issued by a regulatory authority.

25. A kit for treating or preventing a condition or disease mediated by a target of interest as recited in any preceding paragraph, the kit comprising a ligand capable of specifically binding a target of interest encoded by a nucleotide sequence comprising an allele having a cumulative human allele frequency of less than 50% and the allele is found in at least 2 different ethnic populations; and optionally in combination with a label or instructions for use to treat and/or prevent said disease or condition in a human; optionally wherein the label or instructions comprise a marketing authorisation number issued by a regulatory agency; optionally wherein the kit comprises an injection pen or IV container that comprises the ligand.

26. The composition of paragraph 24 or the kit of paragraph 25, wherein the regulatory agency is FDA or EMA.

27. A method of producing an anti-human TOI antibody binding site, the method comprising obtaining a plurality of anti-TOI antibody binding sites, screening the antibody binding sites for binding to a TOI comprising an amino acid sequence encoded by a nucleotide sequence comprising an allele having a cumulative human allele frequency of less than 50% and/or a total human genotype frequency of less than 50%, or to a peptide thereof that comprises an amino acid variation from the corresponding sequence encoded by the TOI-encoding nucleotide sequence comprising an allele having the highest cumulative human allele frequency and/or the highest total human genotype frequency, and isolating an antibody binding site that binds in the screening step.

28. A method of producing an anti-human TOI antibody, the method comprising immunising a non-human vertebrate with a TOI comprising an amino acid sequence encoded by a nucleotide sequence comprising an allele having a cumulative human allele frequency of less than 50% and/or a total human genotype frequency of less than 50%, or to a peptide thereof that comprises an amino acid variation from the corresponding sequence encoded by the TOI-encoding nucleotide sequence comprising an allele having the highest cumulative human allele frequency and/or the highest total human genotype frequency, and isolating an antibody that binds a TOI comprising an amino acid sequence encoded by a TOI nucleotide sequence comprising an allele having a cumulative human allele frequency of less than 50% and/or a total human genotype frequency of less than 50%, and optionally producing a TOI-binding fragment or derivative of the isolated antibody.

29. The method of paragraph 28, wherein the non-human vertebrate is a mouse or a rat.

30. The method of paragraph 29 or 30, comprising the step of obtaining a nucleic acid encoding the antibody, fragment, derivative or binding site and optionally inserting the nucleic acid in an expression vector.

31. A kit for TOI genotyping a human, wherein the kit comprises a nucleic acid comprising a nucleotide sequence that specifically hybridises to a TOI nucleotide sequence selected having a cumulative human allele frequency of less than 50% and/or a total human genotype frequency of less than 50% or an RNA transcript thereof and/or the nucleic acid comprises a nucleotide sequence that comprises at least 10 contiguous nucleotides of a TOI nucleotide sequence having a cumulative human allele frequency of less than 50% and/or a total human genotype frequency of less than 50% or is an antisense sequence thereof.

32. A kit for TOI genotyping or phenotyping a human, wherein the kit comprises a ligand capable of binding a target of interest encoded by a nucleotide sequence comprising an allele having a cumulative human allele frequency of less than 50% or an antibody, fragment or derivative produced by the method of any one of paragraphs 28 to 30.

33. The kit of paragraph 32, wherein the allele is found in at least 2 different ethnic populations.

34. Use of an anti-TOI ligand that specifically binds a human TOI comprising an amino acid sequence encoded by a TOI nucleotide sequence having a cumulative human allele frequency of less than 50% and/or a total human genotype frequency of less than 50%, in the manufacture of a medicament for treating and/or preventing a TOI-mediated disease or condition in a human whose genome comprises a TOI nucleotide sequence having a cumulative human allele frequency of less than 50% and/or having a total human genotype frequency of less than 50%.

35. Use of an anti-TOI ligand that specifically binds a human TOI comprising an amino acid sequence encoded by a TOI nucleotide sequence having a cumulative human allele frequency of less than 50% and/or a total human genotype frequency of less than 50%, in the manufacture of a medicament for targeting said TOI in a human to treat and/or prevent a disease or condition mediated by TOI.

36. A method of targeting a Target of Interest (TOI) for treating and/or preventing a TOI-mediated disease or condition in a human, the method comprising administering an anti-TOI ligand to a human comprising a TOI nucleotide sequence comprising an allele selected as having a cumulative human allele frequency of less than 50% and/or a total human genotype frequency of less than 50%, whereby a TOI encoded by said nucleotide sequence is targeted.

37. The method of paragraph 36, wherein the method comprises targeting a human TOI comprising an amino acid sequence with said ligand to treat and/or prevent said disease or condition in said human, wherein said amino acid sequence is encoded by a nucleotide sequence comprising an allele having a cumulative human allele frequency of less than 50% and/or a total human genotype frequency of less than 50%.

38. A method of Target of Interest (TOI) genotyping a nucleic acid sample of a human, the method comprising assaying in the sample the presence of a TOI nucleotide sequence comprising an allele having a cumulative human allele frequency of less than 50% and/or having a total human genotype frequency of less than 50%.

39. A method of Target of Interest (TOI) typing a protein sample of a human, the method comprising assaying the sample the presence of a TOI amino acid sequence encoded by a TOI nucleotide sequence comprising an allele having a cumulative human allele frequency of less than 50% and/or having a total human genotype frequency of less than 50%.

40. The method of paragraph 38 or 39, comprising obtaining a sample of serum, blood, feces, hair, urine or saliva from a human, whereby the nucleic acid or protein sample is obtained for use in the step of assaying said sequence.

41. The method of any one of paragraphs 38-40, comprising using a ligand capable of targeting a nucleic acid sequence comprising an allele having a cumulative human allele frequency of less than 50% and/or having a total human genotype frequency of less than 50% or a ligand capable of specifically binding the TOI encoded by said nucleic acid sequence to carry out said identifying step.

42. A diagnostic kit comprising a ligand that is capable of binding a human Target of Interest (TOI) comprising an amino acid sequence encoded by a TOI nucleotide sequence comprising an allele having a cumulative human allele frequency of less than 50% and/or a total human genotype frequency of less than 50% and instructions for carrying out the method of any one of paragraphs 38-41.

43. The diagnostic kit wherein the ligand is selected from an antibody, antibody fragment, antibody portion, affybody, oligonucleotide, modified oligonucleotide, antisense oligonucleotide, siRNA, and microRNA.

44. A diagnostic kit comprising a nucleic acid probe comprising a nucleotide sequence that specifically hybridises a Target of Interest (TOI) nucleotide sequence comprising an allele having a cumulative human allele frequency of less than 50% and/or a total human genotype frequency of less than 50% or an RNA transcript thereof and instructions for carrying out the method of paragraph 38 or 39.

45. The method, ligand, composition, kit or use of any preceding paragraph, wherein the TOI is encoded by a nucleotide sequence having a cumulative human allele frequency from 1 to 10% and/or a total human genotype frequency from 1 to about 15% or from 1 to 15%.

46. The method, ligand, composition, kit or use of any preceding paragraph wherein the TOI is a human TOI selected from Table 5; optionally for treating and/or preventing a corresponding disease or condition as set out in Table 5.

47. A method of treating or preventing a disease or condition in a human, wherein the disease or condition is mediated by a Target of Interest (TOI), wherein the TOI is present in humans as different polymorphic variants, the method comprising administering to the human determined to be positive for the TOI polymorphic variant, wherein the TOI in said human is encoded by a nucleotide sequence comprising an allele having a cumulative human allele frequency of less than 50% and/or wherein the TOI in said human is encoded by a nucleotide sequence comprising an allele having total human genotype frequency of less than 50% an anti-TOI ligand to target the TOI in the human to treat or prevent said disease or condition.

48. The method of paragraph 47, wherein the anti-TOI ligand is selected from an antibody, an antibody portion, an antibody fragment, an affibody, an antisense oligonucleotide, an siRNA, and a microRNA.

49. An anti-TOI ligand that specifically binds to a TOI as defined in paragraph 1, for use in the method of any preceding paragraph (eg, for use in the method of any of paragraphs 1 to 8 and 19 to 23).

50. The ligand of paragraph 49, wherein the ligand is an anti-TOI trap, antibody or antibody fragment.

51. The ligand of paragraph 49 or 50, wherein the ligand is for subcutaneous or intravenous administration to a human, or is comprised by an injectable preparation.

52. An injection device comprising the ligand of any one of paragraphs 49 to 51.

Additional Tailoring of Ligands to Genotype and/or Phenotype of the Human Patient As described herein, the present invention contemplates ligands (eg, antibodies and fragments) whose binding site specificities have been matched to one or more variant human TOIs (eg, PCSK9 or IL6R). Additionally or alternatively (and as further illustrated in the non-limiting Examples below), an optional aspect of the invention provides for matching of other features of the ligand to the patient's genotype or phenotype. In this respect, for example, the invention includes the ability to match amino acid sequence variation in a human patient to one or more ligand sequences or domains outside of the binding sites. For example, where the ligand comprises or consists of a human TOI-binding antibody or an anti-human TOI receptor Fc fusion, this aspect of the invention provides for more tailored matching of one or more constant region domains (eg, the Fc) to the patient genotype or phenotype. Additionally or alternatively, it is contemplated that sequence variation in the binding site can be similarly matched to the patient's genotype or phenotype. The present inventor has done this by considering the SNP occurrences in sequences encoding one or more parts of the ligand, eg, SNP occurrences in one, more or all of the gene segments from which the variable domain(s) and/or constant region domain(s) are derived. The inventor realised that it would be desirable to match the ligand to one or more corresponding variant SNPs found in the patient to be treated therapeutically and/or prophylactically. Matching could involve designing the ligand specifically for a patient of known phenotype and/or genotype, or matching could involve choosing a ligand by determining that there is correspondence between variation in the patient's phenotype or genotype with the variation in the ligand amino acid and/or corresponding nucleotides.

A key consideration for the inventor was the desire to promote compatibility of the ligand with the patient's body, and in particular, the possible patient immune system responses to administered ligands. For example, it has been observed that human patients receiving human or humanised antibody drugs may mount an immune response against the incoming antibody (a so-called HAHA response) which results in the patient producing anti-drug antibodies as a result of the patient's immune system recognising the drug as foreign. For example, studies have suggested that some patients receiving HUMIRA™ (adalimumab), currently the biggest selling antibody medicine, mount a HAHA immune response against the medicine, and this may impact treatment adversely. Reference is made to JAMA. 2011; 305(14):1460-1468. doi:10.1001/jama.2011.406: "Development of Anti-drug Antibodies Against Adalimumab and Association With Disease Activity and Treatment Failure During Long-term Follow-up", GM Bartelds et al. The authors concluded that results of this study showed that development of antidrug antibodies was associated with a negative outcome of adalimumab treatment in human RA patients. It was reported that not only did patients with anti-adalimumab antibodies discontinue treatment more often and earlier than patients without anti-adalimumab antibodies, they also had a higher disease activity during treatment and only rarely came into remission. In addition, reportedly the data showed that two-thirds of the anti-adalimumab antibody-positive patients developed these antibodies in the first 28 weeks of treatment and that the presence of anti-adalimumab antibodies substantially influenced serum adalimumab concentrations.

This HAHA theme is, therefore, a significant concern and this has been considered by the regulatory authorities. For example, the European Medicines Agency (EMA) has issued a "Guideline on immunogenicity assessment of monoclonal antibodies intended for in vivo clinical use" (available on the world wide web at ema.europa.eu/docs/en_GB/documentlibrary/Scientific_guideline/2012/06/WC500128688.pdf; EMA/CHMP/BMWP/86289/2010, addendum to EMEA/CHMP/BMWP/14327/2006), which came into force on 1 Dec. 2012. As such, it is good practice for researchers to identify and assess risk of anti-antibody drug occurrence and effects.

The present aspect of the invention, by more closely tailoring the ligand itself (as well as its specificity) to the patient, helps to address these considerations when designing and administering anti-human TOI medicines for treating and/or preventing human TOI-related diseases and conditions.

The inventor also considered the desirability to tailor the variation in the ligand constant region (eg, for an antibody or Fc-containing ligand), mindful that then the constant region being administered to the patient would be tuned to the various components, such as patient's Fc receptors, that would interact with the constant region in the patient. Good Fc/Fc receptor interactions can be important for drug recycling (via the FcRn) to provide for useful half-lives in vivo or for use in cell killing, eg, for cancer indications. In this way it is possible, therefore, to tune the effector function of the constant region (eg, Fc) to the patient more closely, to promote efficacy. For example, more efficacious drugs are desirable for better patient treatment and may provide the possibility of lowered dosing and/or dosing frequencies.

Thus, in examples of this aspect, the invention provides the following (set out as clauses):—

1. The ligand, method, use, kit or composition of the invention, wherein
    (i) the ligand (eg, antibody or fragment) comprises
        (c) a variable domain that is encoded by a human V region nucleotide sequence, wherein the V nucleotide sequence is derived from recombination of human VH, D and JH gene segments or human VL and JL gene segments; or
        (d) a constant region domain encoded by a C region gene segment;
        Wherein a first gene segment of said gene segments of (a), or said C region gene segment of (b) comprises a first single nucleotide polymorphism (SNP) encoding a first amino acid polymorphism; and
    (ii) the genome of said human comprises said first SNP or wherein said human expresses (a') an antibody variable domain comprising said first amino acid polymorphism or (b') an antibody constant domain comprising said first amino acid polymorphism.
2. The ligand, method, use, kit or composition of clause 1, wherein blood of said human comprises substantially no antibodies that specifically bind to the domain comprising said first amino acid polymorphism as determined in an in vitro binding assay.
3. The ligand, method, use, kit or composition of clause 2, wherein SPR is used to carry out said assay.
    In an alternative, ELISA is used.
4. The ligand, method, use, kit or composition of any one of clauses 1 to 3, wherein the genome of said human comprises said first gene segment (when (a) applies) or said C region gene segment (when (b) applies).
5. The ligand, method, use, kit or composition of any one of clauses 1 to 4, wherein said first segment or a second segment of said segments of (a), or said C region gene segment of (b), comprises a second SNP encoding a second amino acid polymorphism; and wherein the genome of said human comprises said second SNP or wherein said human expresses (a") an antibody variable domain comprising said second amino acid polymorphism or (b") an antibody constant region domain comprising said first and second amino acid polymorphisms.
6. The ligand, method, use, kit or composition of clause 5, wherein said human expresses an antibody variable domain comprising said first and second amino acid polymorphisms.
7. The ligand, method, use, kit or composition of clause 5 or 6, wherein the first and second SNPs of said genome are comprised by the same antibody gene segment.

For example, the first and second SNPs of the genome are comprised by an IGHG1*01 gene segment and said first segment of (a) is an IGHG1*01 gene segment.

For example, the first and second SNPs of the genome are comprised by an IGHG2*01 gene segment and said first segment of (a) is an IGHG2*01 gene segment.

8. The ligand, method, use, kit or composition of any one of clauses 1 to 7, wherein each SNP is a variable region gene segment SNP.
9. The ligand, method, use, kit or composition of any one of clauses 1 to 7, wherein each SNP is a constant region gene segment SNP, eg each SNP is a gamma-1 constant region gene segment SNP, or a gamma-2 constant region gene segment SNP, or a gamma-3 constant region gene segment SNP or a gamma-4 constant region gene segment SNP.
10. The ligand, method, use, kit or composition of clause 9, wherein the first SNP is a CH1, CH2, CH3 or CH4 gene segment SNP and/or the second SNP is a CH1, CH2, CH3 or CH4 gene segment SNP.
11. The ligand, method, use, kit or composition of any one of clauses 1 to 8, wherein each SNP is a variable domain SNP, eg, a VH domain SNP, or a Vκ domain SNP, or a Vλ SNP.
12. The ligand, method, use, kit or composition of any one of clauses 1 to 11, wherein said constant region domain of (b) is comprised by an antibody Fc region.
13. The ligand, method, use, kit or composition of any one of clauses 1 to 12, wherein the ligand (eg, antibody or fragment) has been determined to specifically bind one or more human TOI variants as disclosed herein, for example, with a KD of 1 nM or less (eg, 100 or 10 pM or less) as determined by SPR.
14. The ligand, method, use, kit or composition of the invention (eg, according to any one of clauses 1 to 13), wherein the ligand comprises or consists of an antibody or fragment that comprises a human antibody variable domain derived from the recombination of a human V gene segment and a human J gene segment (and optionally a human D gene segment when the variable domains are VH domains); and wherein the genome of the human comprises said human V gene segment and/or the human expresses antibodies comprising antibody variable domains derived from the recombination of said human V gene segment and a human J gene segment (and optionally a human D gene segment).

In an example, the V gene segment is any of the V gene segments disclosed in WO2013041844, a 1000 Genomes database and/or www.imgt.org, the disclosures of which (including disclosure relating to sequence) is explicitly incorporated herein by reference for use in the present invention.

15. The ligand, method, use, kit or composition of the invention (eg, according to any one of clauses 1 to 14), wherein the ligand (eg, comprising or consisting of an antibody or fragment or an Fc-fused human TOI receptor) comprises a human heavy chain constant domain encoded by a first constant region nucleotide sequence; and wherein the genome of the human comprises a heavy chain constant region nucleotide sequence that is identical to said first constant region nucleotide sequence and/or the human expresses antibodies comprising said human constant domain.
16. The ligand, method, use, kit or composition of the invention (eg, according to any one of clauses 1 to 15), wherein the ligand (eg, comprising or consisting of an antibody or fragment or an Fc-fused human TOI receptor) comprises a human gamma heavy chain CH1 domain encoded by a CH1 nucleotide sequence; and wherein the genome of the human comprises a gamma heavy chain constant region nucleotide sequence that is identical to said CH1 nucleotide sequence and/or the human expresses antibodies comprising said human gamma CH1 domain.

17. The ligand, method, use, kit or composition of the invention (eg, according to any one of clauses 1 to 16), wherein the ligand (eg, comprising or consisting of an antibody or fragment or an Fc-fused human TOI receptor) comprises a human gamma heavy chain CH2 domain encoded by a CH2 nucleotide sequence; and wherein the genome of the human comprises a gamma heavy chain constant region nucleotide sequence that is identical to said CH2 nucleotide sequence and/or the human expresses antibodies comprising said human gamma CH2 domain.

18. The ligand, method, use, kit or composition of the invention (eg, according to any one of clauses 1 to 17), wherein the ligand (eg, comprising or consisting of an antibody or fragment or an Fc-fused human TOI receptor) comprises a human gamma heavy chain CH3 domain encoded by a CH3 nucleotide sequence; and wherein the genome of the human comprises a gamma heavy chain constant region nucleotide sequence that is identical to said CH3 nucleotide sequence and/or the human expresses antibodies comprising said human gamma CH3 domain.

19. The ligand, method, use, kit or composition of the invention (eg, according to any one of clauses 1 to 18), wherein the ligand (eg, comprising or consisting of an antibody or fragment or an Fc-fused human TOI receptor) comprises a human gamma heavy chain CH4 domain encoded by a CH4 nucleotide sequence; and wherein the genome of the human comprises a gamma heavy chain constant region nucleotide sequence that is identical to said CH4 nucleotide sequence and/or the human expresses antibodies comprising said human gamma CH4 domain.

20. The ligand, method, use, kit or composition of the invention (eg, according to any one of clauses 1 to 19), wherein the ligand (eg, comprising or consisting of an antibody or fragment or an Fc-fused human TOI receptor) comprises a human gamma heavy chain Fc region encoded by a Fc nucleotide sequence; and wherein the genome of the human comprises a gamma heavy chain constant region nucleotide sequence that is identical to said Fc nucleotide sequence and/or the human expresses antibodies comprising said human gamma Fc region.

21. The ligand, method, use, kit or composition of any one of clauses 16 to 20, wherein said human gamma heavy chain is a human gamma-1 heavy chain.

22. The ligand, method, use, kit or composition of any one of clauses 16 to 20, wherein said human gamma heavy chain is a human gamma-2 heavy chain.

23. The ligand, method, use, kit or composition of any one of clauses 16 to 20, wherein ligand comprises a human IGHG1*01 gamma-1 heavy chain constant region.

24. The ligand, method, use, kit or composition of any one of clauses 16 to 20, wherein ligand comprises a human IGHG2*01 gamma-1 heavy chain constant region.

25. The ligand, method, use, kit or composition of any one of clauses 15 to 24, wherein the human has been or is genotyped as positive for said heavy chain constant region nucleotide sequence.

26. The ligand, method, use, kit or composition of clause 23, wherein the human has been or is genotyped as positive for human IGHG1*01 nucleotide sequence.

27. The ligand, method, use, kit or composition of clause 24, wherein the human has been or is genotyped as positive for human IGHG2*01 nucleotide sequence.

28. The ligand, method, use, kit or composition of any one of clauses 16 to 24, wherein the human has been or is phenotyped as positive for said gamma heavy chain constant domain, CH1, CH2, CH3, CH4 or Fc.

29. The ligand, method, use, kit or composition of clause 28, (i) when dependent from clause 23, wherein the human has been or is phenotyped as positive for a human IGHG1*01 gamma heavy chain constant domain, CH1, CH2, CH3, CH4 or Fc or (ii) when dependent from clause 24, wherein the human has been phenotyped as positive for a human IGHG2*01 gamma heavy chain constant domain, CH1, CH2, CH3, CH4 or Fc.

30. The method or use of any one of clauses 16 to 24 and 26 to 29, comprising genotyping the human as positive for said gamma heavy chain constant region nucleotide sequence, eg, positive for said gamma heavy chain constant domain, CH1, CH2, CH3, CH4 or Fc nucleotide sequence; positive for said human IGHG1*01 gamma heavy chain constant region, CH1, CH2, CH3, CH4 or Fc nucleotide sequence; or positive for said human IGHG2*01 gamma heavy chain constant region, CH1, CH2, CH3, CH4 or Fc nucleotide sequence.

31. The method or use of any one of clauses 16 to 24 and 26 to 30, comprising phenotyping the human as positive for said gamma heavy chain constant region, eg, positive for said gamma heavy chain constant domain, CH1, CH2, CH3, CH4 or Fc; positive for said human IGHG1*01 gamma heavy chain constant domain, CH1, CH2, CH3, CH4 or Fc; or positive for said human IGHG2*01 gamma heavy chain constant domain, CH1, CH2, CH3, CH4 or Fc.

Examples of Tailored Ligands

The inventor analysed amino acid variability and distribution amongst large representative human samples. The result of the analysis for example antibody gene segments is shown in Table 9.

In a first example, the inventor identified the possibility of addressing the rarer IGH-gamma-1 SNPs 204D (observed cumulative frequency of 0.296) and 206L (observed cumulative frequency of 0.283) individually or in combination. These residues are part of the CH3 domain, and as such they form part of antibody Fc regions. Thus, matching of these CH3 variations with the patient is especially beneficial for reasons as discussed above. Thus, this example provides aspects set out in the following clauses.

32. The ligand, method, use, kit or composition of the invention (eg, according to any one of clauses 1 to 31), wherein the ligand (eg, comprising or consisting of an antibody or fragment or an Fc-fused TOI receptor) comprises a human gamma-1 heavy chain constant region that comprises an Asp corresponding to position 204 of SEQ ID NO: 42 or a Leu corresponding to position 206 of SEQ ID NO: 42 and wherein the genome of the human comprises a gamma-1 heavy chain constant region nucleotide sequence that encodes such an Asp or Leu or the human expresses antibodies comprising human gamma-1 constant regions comprising such an Asp or Leu.

The skilled person will be familiar with techniques for determining genome sequences of a human, eg, by using a sample containing genomic DNA and/or RNA, sequencing and comparing using bioinformatics or other computer tools to compare the sampled sequence with sequences of human alleles (eg, as shown in the IMGT, 100 genomes or other database as disclosed herein). In an example, the sample is a blood or saliva or cheek swab sample.

33. The ligand, method, use, kit or composition of clause 32, wherein the ligand comprises a human gamma-1 heavy chain constant region that comprises an Asp corresponding to position 204 of SEQ ID NO: 42 and a Leu corresponding to position 206 of SEQ ID NO: 42.

34. The ligand, method, use, kit or composition of clause 32 or 33, wherein the genome of the human comprises a gamma-1 heavy chain constant region nucleotide sequence that encodes such an Asp and Leu or the human expresses antibodies comprising human gamma-1 constant regions comprising such an Asp and Leu.
35. The ligand, method, use, kit or composition of clause 32, 33 or 34, wherein the ligand comprises a human IGHG1*01 gamma-1 heavy chain constant region, eg, an Fc, CH1, CH2 and/or CH3 domain encoded by human IGHG1*01.
36. The ligand, method, use, kit or composition of any one of clauses 32 to 35, wherein the genome of the human comprises a human IGHG1*01 nucleotide sequence or the human expresses antibodies comprising human constant domains encoded by a human IGHG1*01 nucleotide sequence.
37. The ligand, method, use, kit or composition of any one of clauses 32 to 36, wherein the ligand comprises a hinge region encoded by human IGHG1*01.
38. The ligand, method, use, kit or composition of any one of clauses 32 to 37, wherein the ligand comprises or consists of an antibody, wherein the antibody comprises heavy chains that comprise SEQ ID NO: 61.
39. The ligand, method, use, kit or composition of any one of clauses 32 to 38, wherein the human is of European ancestry.

As shown in Table 9, 204D and 206L are found in such humans.

40. The ligand, method, use, kit or composition of any one of clauses 32 to 39, wherein the human has been or is genotyped as positive for said Asp and/or Leu.
41. The ligand, method, use, kit or composition of any one of clauses 32 to 40, wherein the human has been or is genotyped as positive for human IGHG1*01.
42. The ligand, method, use, kit or composition of any one of clauses 32 to 41, wherein the human has been or is phenotyped as positive for a human IGHG1*01 CH3.
43. The method or use of any one of clauses 32 to 42, comprising selecting a said human whose genome comprises a codon(s) encoding said Asp and/or Leu; comprises human IGHG1*01; or comprises a human IGHG1*01 CH3.
44. The method or use of any one of clauses 32 to 43, comprising selecting a said human whose phenotype comprises said Asp and/or Leu; a human IGHG1*01 region; or a human IGHG1*01 CH3.
44a. The ligand, method, use, kit or composition of any one of clauses 32 to 44, wherein the human expresses antibodies comprising human gamma-1 constant regions comprising such an Asp and Leu.

In a second example, the inventor identified the possibility of addressing IGH-gamma-2 SNPs. This included consideration of Fc region variation—in this respect, the inventor focused on positions 161 and 257 which are in the Fc region. Thus, this example provides aspects set out in the following clauses.

45. The ligand, method, use, kit or composition of the invention (eg, according to any one of clauses 1 to 31), wherein the ligand (eg, comprising or consisting of an antibody or fragment or an Fc-fused TOI receptor) comprises a human gamma-2 heavy chain constant region that comprises an amino acid selected from the group consisting of a Pro corresponding to position 72 of SEQ ID NO: 44, an Asn corresponding to position 75 of SEQ ID NO: 44, a Phe corresponding to position 76 of SEQ ID NO: 44, a Val corresponding to position 161 of SEQ ID NO: 44 and an Ala corresponding to position 257 of SEQ ID NO: 44; and wherein the genome of the human comprises a gamma-2 heavy chain constant region nucleotide sequence that encodes such a selected amino acid or the human expresses antibodies comprising human gamma-2 constant regions comprising such a selected amino acid.
46. The ligand, method, use, kit or composition of clause 45, wherein the ligand comprises a human gamma-2 heavy chain constant region that comprises (i) a Pro corresponding to position 72 of SEQ ID NO: 44, an Asn corresponding to position 75 of SEQ ID NO: 44, a Phe corresponding to position 76 of SEQ ID NO: 44 and optionally (ii) a Val corresponding to position 161 of SEQ ID NO: 44 and/or an Ala corresponding to position 257 of SEQ ID NO: 44; and wherein the genome of the human comprises a gamma-2 heavy chain constant region nucleotide sequence that encodes such amino acids of (i) or the human expresses antibodies comprising human gamma-2 constant regions comprising such amino acids of (i).

This example focuses on CH1 variation.

47. The ligand, method, use, kit or composition of clause 45 or 46, wherein the ligand comprises a human gamma-2 heavy chain constant region that comprises (i) a Val corresponding to position 161 of SEQ ID NO: 44 and an Ala corresponding to position 257 of SEQ ID NO: 44 and optionally (ii) an amino acid selected from the group consisting of a Pro corresponding to position 72 of SEQ ID NO: 44, an Asn corresponding to position 75 of SEQ ID NO: 44 and a Phe corresponding to position 76 of SEQ ID NO: 44; and wherein the genome of the human comprises a gamma-2 heavy chain constant region nucleotide sequence that encodes such amino acids of (i) or the human expresses antibodies comprising human gamma-2 constant regions comprising such amino acids of (i).

This example focuses on Fc variation.

48. The ligand, method, use, kit or composition of any one of clauses 45 to 47, wherein the ligand comprises a human IGHG2*01 gamma-2 heavy chain constant region, eg, an Fc, CH1, CH2 and/or CH3 domain encoded by human IGHG2*01.
49. The ligand, method, use, kit or composition of any one of clauses 45 to 48, wherein the genome of the human comprises a human IGHG2*01 nucleotide sequence or the human expresses antibodies comprising human constant domains encoded by a human IGHG2*01 nucleotide sequence.
50. The ligand, method, use, kit or composition of any one of clauses 45 to 49, wherein the ligand comprises a hinge region encoded by human IGHG2*01.
51. The ligand, method, use, kit or composition of any one of clauses 45 to 50, wherein the ligand comprises or consists of an antibody, wherein the antibody comprises heavy chains that comprise SEQ ID NO: 63 or 65.
52. The ligand, method, use, kit or composition of any one of clauses 45 to 51, wherein the human is of European, African American, or European American ancestry.
53. The ligand, method, use, kit or composition of any one of clauses 45 to 52, wherein the human has been or is genotyped as positive for one, more or all of said Pro, Asn, Phe, Val and Ala.
54. The ligand, method, use, kit or composition of any one of clauses 45 to 53, wherein the human has been or is genotyped as positive for human IGHG2*01.
55. The ligand, method, use, kit or composition of any one of clauses 45 to 54, wherein the human has been or is phenotyped as positive for a human IGHG2*01 CH1.

56. The ligand, method, use, kit or composition of any one of clauses 45 to 55, wherein the human has been or is phenotyped as positive for a human IGHG2*01 CH2.

57. The ligand, method, use, kit or composition of any one of clauses 45 to 56, wherein the human has been or is phenotyped as positive for a human IGHG2*01 CH3.

58. The method or use of any one of clauses 45 to 57, comprising selecting a said human whose genome comprises a codon(s) encoding one, more or all of said Pro, Asn, Phe, Val and Ala; comprises human IGHG2*01; or comprises a human IGHG2*01 CH1, CH2 and/or CH3.

59. The method or use of any one of clauses 45 to 58, comprising selecting a said human whose phenotype comprises one, more or all of said Pro, Asn, Phe, Val and Ala; a human IGHG2*01 region; or a human IGHG2*01 CH1, CH2 and/or CH3.

60. The ligand, method, use, kit or composition of any one of clauses 45 to 59, wherein the human expresses antibodies comprising human gamma-2 constant regions comprising such a Pro, Asn, Phe, Val and Ala.

In a third example, the inventor addressed human kappa constant region variation. Thus, the present aspect of the invention also provides the following.

61. The ligand, method, use, kit or composition of the invention (eg, according to any one of clauses 1 to 60), wherein the ligand (eg, comprising or consisting of an antibody or fragment or an Fc-fused TOI receptor) comprises a human kappa light chain constant region that comprises a Val corresponding to position 84 of SEQ ID NO: 50 or a Cys corresponding to position 87 of SEQ ID NO: 50; and wherein the genome of the human comprises a kappa light chain constant region nucleotide sequence that encodes such a Val or Cys or the human expresses antibodies comprising human kappa light chain constant regions comprising such a Val or Cys.

62. The ligand, method, use, kit or composition of clause 61, wherein the ligand comprises a human kappa light chain constant region that comprises a Val corresponding to position 84 of SEQ ID NO: 50 and a Cys corresponding to position 87 of SEQ ID NO: 50.

63. The ligand, method, use, kit or composition of clause 61 or 62, wherein the genome of the human comprises a kappa light chain constant region nucleotide sequence that encodes such a Val and Cys or the human expresses antibodies comprising human kappa constant regions comprising such a Val and Cys.

64. The ligand, method, use, kit or composition of any one of clauses 61 to 63, wherein the antibody or fragment comprises a human IGKC*01 kappa light chain constant region.

65. The ligand, method, use, kit or composition of any one of clauses 61 to 64, wherein the ligand comprises or consists of an antibody, wherein the antibody comprises light chains that comprise SEQ ID NO: 62 or 66.

66. The ligand, method, use, kit or composition of any one of clauses 61 to 65, wherein the ligand comprises or consists of an antibody, wherein the antibody comprises a light chain variable domain derived from recombination of a human Vκ gene segment and a human Jκ gene segment, wherein the Jκ gene segment is IGKJ2*01 (SEQ ID NO: 57).

67. The ligand, method, use, kit or composition of any one of clauses 61 to 66, wherein the human has been or is phenotyped as positive for said Val and/or Cys.

68. The ligand, method, use, kit or composition of any one of clauses 61 to 67, wherein the human has been or is genotyped as positive for human IGKC*01.

69. The ligand, method, use, kit or composition of any one of clauses 61 to 68, wherein the human has been or is phenotyped as positive for a human IGKC*01 domain.

70. The method or use of any one of clauses 61 to 69, comprising selecting a said human whose genome comprises a codon(s) encoding said Val and/or Cys; or comprises human IGKC*01.

71. The method or use of any one of clauses 61 to 70, comprising selecting a said human whose phenotype comprises such a Val and/or Cys; or comprises a human IGKC*01 domain.

72. The ligand, method, use, kit or composition of any one of clauses 61 to 71, wherein the human expresses antibodies comprising human kappa constant domains comprising such a Val and Cys, eg, expresses human IGKC*01 constant domains.

In a fourth example, the inventor addressed human lambda constant region variation. Thus, this example provides aspects set out in the following clauses.

73. The ligand, method, use, kit or composition of the invention (eg, according to any one of clauses 1 to 60), wherein the ligand (eg, comprising or consisting of an antibody or fragment or an Fc-fused TOI receptor) comprises a human IGLC2*01 light chain constant region; and wherein the genome of the human comprises a human IGLC2*01 nucleotide sequence or the human expresses antibodies comprising human light chain IGLC2*01 constant regions.

74. The ligand, method, use, kit or composition of clause 73, wherein the antibody comprises light chains that comprise SEQ ID NO: 64.

75. The ligand, method, use, kit or composition of clause 73 or 74, wherein the human has been or is genotyped as positive for human IGLC2*01.

76. The ligand, method, use, kit or composition of any one of clauses 73 to 75, wherein the human has been or is phenotyped as positive for a human IGLC2*01 domain.

77. The method or use of any one of clauses 73 to 76, comprising selecting a said human whose genome comprises human IGLC2*01.

78. The method or use of any one of clauses 73 to 77, comprising selecting a said human whose phenotype comprises a human IGLC2*01 domain.

79. The ligand, method, use, kit or composition of any one of clauses 73 to 78, wherein the human expresses antibodies comprising human lambda IGLC2*01 constant domains.

In a fifth example, the inventor addressed human heavy chain variable region variation. Thus, this example provides aspects set out in the following clauses.

80. The ligand, method, use, kit or composition of the invention (eg, according to any one of clauses 1 to 79), wherein the ligand comprises or consists of an antibody or fragment, wherein the antibody or fragment comprises a VH domain that is derived from the recombination of a human VH gene segment, a human D gene segment and a human JH gene segment, wherein the VH gene segment is selected from the group consisting of (i) IGHV1-18*01 and the genome of the human comprises a human IGHV1-18*01 nucleotide sequence or the human expresses antibodies comprising variable domains derived from the recombination of human IGHV1-18*01; or (ii) IGVH1-46*01 and the genome of the human comprises a human IGHV1-46*01 nucleotide sequence or the human expresses antibodies comprising variable domains derived from the recombination of human IGHV1-46*01.

81. The ligand, method, use, kit or composition of clause 80, wherein the antibody or fragment comprises a one more or all of a CH1 domain, CH2 domain, CH3 domain, hinge or Fc encoded by human IGHG2*01.
82. The ligand, method, use, kit or composition of clause 80 or 81, wherein the antibody or fragment comprises heavy chains that comprise SEQ ID NO: 63 or 65.
83. The ligand, method, use, kit or composition of any one of clauses 80 to 82, wherein the human has been or is genotyped as positive for said selected VH gene segment, positive for human IGHV1-18*01 or IGVH1-46*01.
84. The method or use of any of clauses 80 to 83, comprising genotyping the human as positive for said selected VH gene segment, eg, positive for human IGHV1-18*01 or IGVH1-46*01.

In a sixth example, the inventor addressed human light chain variable region variation. Thus, this example provides aspects set out in the following clauses.

85. The ligand, method, use, kit or composition of the invention (eg, according to any one of clauses 1 to 84), wherein the ligand comprises or consists of an antibody or fragment, wherein the antibody or fragment comprises a VL domain that is derived from the recombination of a human VL gene segment and a human JL gene segment, wherein the VL gene segment is selected from the group consisting of (i) IGKV4-1*01 and the genome of the human comprises a human IGKV4-1*01 nucleotide sequence or the human expresses antibodies comprising variable domains derived from the recombination of human IGKV4-1*01; (ii) IGLV2-14*01 and the genome of the human comprises a human IGLV2-14*01 nucleotide sequence or the human expresses antibodies comprising variable domains derived from the recombination of human IGLV2-14*01; or (iii) IGKV1-13*02 and the genome of the human comprises a human IGKV1-13*02 nucleotide sequence or the human expresses antibodies comprising variable domains derived from the recombination of human IGKV1-13*02.
86. The ligand, method, use, kit or composition of clause 85, wherein the antibody comprises light chains that comprise SEQ ID NO: 62, 64 or 66.
87. The ligand, method, use, kit or composition of clause 85 or 86, wherein the antibody or fragment comprises a light chain variable domain derived from recombination of a human Vκ gene segment and a human Jκ gene segment, wherein the Jκ gene segment is IGKJ2*01 (SEQ ID NO: 57; wherein (i) or (iii) applies.
88. The ligand, method, use, kit or composition of any one of clauses 85 to 87, wherein the human has been or is genotyped as positive for said selected VL gene segment, eg, positive for human IGKV4-1*01, IGLV2-14*01 or IGKV1-13*02.
89. The method or use of clause 88, comprising genotyping the human as positive for said selected VL gene segment, eg, genotyping the human as positive for human IGKV4-1*01, IGLV2-14*01 or IGKV1-13*02.
90. The ligand, method, use, kit or composition of any one of clauses 1 to 89, wherein the ligand (eg, antibody or fragment) binds said human TOI with a dissociation constant (Kd) of 1 nM or less as determined by SPR, (eg, 100, 10 or 1 pM or less).

In a specific embodiment, the ligand, antibody or fragment of present invention comprises an Fc region, wherein the Fc region comprises at least one non-native amino acid residue selected from the group consisting of 234D, 234E, 234N, 234Q, 234T, 234H, 234Y, 2341, 234V, 234F, 235A, 235D, 235R, 235W, 235P, 235S, 235N, 235Q, 235T, 235H, 235Y, 2351, 235V, 235F, 236E, 239D, 239E, 239N, 239Q, 239F, 239T, 239H, 239Y, 2401, 240A, 240T, 240M, 241W, 241 L, 241Y, 241E, 241 R. 243W, 243L 243Y, 243R, 243Q, 244H, 245A, 247L, 247V, 247G, 251F, 252Y, 254T, 255L, 256E, 256M, 2621, 262A, 262T, 262E, 2631, 263A, 263T, 263M, 264L, 2641, 264W, 264T, 264R, 264F, 264M, 264Y, 264E, 265G, 265N, 265Q, 265Y, 265F, 265V, 2651, 265L, 265H, 265T, 2661, 266A, 266T, 266M, 267Q, 267L, 268E, 269H, 269Y, 269F, 269R, 270E, 280A, 284M, 292P, 292L, 296E, 296Q, 296D, 296N, 296S, 296T, 296L, 2961, 296H, 269G, 297S, 297D, 297E, 298H, 2981, 298T, 298F, 2991, 299L, 299A, 299S, 299V, 299H, 299F, 299E, 3051, 313F, 316D, 325Q, 325L, 3251, 325D, 325E, 325A, 325T, 325V, 325H, 327G, 327W, 327N, 327L, 328S, 328M, 328D, 328E, 328N, 328Q, 328F, 3281, 328V, 328T, 328H, 328A, 329F, 329H, 329Q, 330K, 330G, 330T, 330C, 330L, 330Y, 330V, 3301, 330F, 330R, 330H, 331G, 331A, 331L, 331M, 331F, 331W, 331K, 331Q, 331E, 331S, 331V, 3311, 331C, 331Y, 331H, 331R, 331N, 331D, 331T, 332D, 332S, 332W, 332F, 332E, 332N, 332Q, 332T, 332H, 332Y, 332A, 339T, 370E, 370N, 378D, 392T, 396L, 416G, 419H, 421K, 440Y and 434W as numbered by the EU index as set forth in Kabat. Optionally, the Fc region may comprise additional and/or alternative non-native amino acid residues known to one skilled in the art (see, e.g., U.S. Pat. Nos. 5,624,821; 6,277,375; 6,737,056; PCT Patent Publications WO 01/58957; WO 02/06919; WO 04/016750; WO 04/029207; WO 04/035752 and WO 05/040217).

In an example the ligand, antibody or fragment comprises one or more human binding sites that specifically bind the TOI (eg, PCSK9, IL4Ra, IL6R, VEGFA or Nav1.7). In an embodiment, the binding sites comprise or consist of human antibody variable domains or human receptors for the TOI (eg, Human receptor binding sites for VEGFA). Furthermore, the ligand, antibody or fragment can be optionally fully human (eg, comprising human constant regions, eg, human Fc regions with or without human CL regions). In an example, the ligand is aflibercept, alirocumab, sarilumab or dupilumab. Fully human ligands maximise compatibility with the human patient when used in the context of the invention wherein the V and/or C regions are tailored to the human genotype and/or phenotype as per the description herein.

Some embodiments of the technology described herein can be defined according to any of the following numbered paragraphs:

1. A method of treating or preventing a disease or condition in a human, wherein the disease or condition is mediated by a Target of Interest (TOI), wherein the TOI is present in humans as different polymorphic variants, the method comprising
   a. Administering to the human an anti-TOI ligand to target a TOI variant in the human and treat or prevent said disease or condition, wherein the TOI in said human is encoded by a nucleotide sequence having a cumulative human allele frequency of less than 50% and/or wherein the TOI in said human is encoded by a nucleotide sequence having a total human genotype frequency of less than 50%;
   wherein
   b. Before step (a) said human has been or is genotyped as positive for said nucleotide sequence or phenotyped as positive for said TOI variant.
2. The method of paragraph 1, wherein before step (a) the ligand has been or is determined as being capable of binding to said TOI variant.
3. A method of treating or preventing a disease or condition in a human, wherein the disease or condition is mediated by a Target of Interest (TOI), wherein the TOI is present in humans as different polymorphic variants, the method comprising a. Administering to the human an anti-TOI ligand to target a TOI variant in the human and treat or prevent said disease or condition, wherein the TOI in said human is encoded by a nucleotide sequence having a cumulative human allele frequency of less than 50% and/or wherein the TOI in said human is encoded by a nucleotide sequence having a total human genotype frequency of less than 50%;
wherein
b. Before step (a) the ligand has been or is determined as capable of binding to said TOI variant.

4. The method of paragraph 3, wherein the genome of said human comprises a nucleotide sequence encoding said TOI variant; and before step (a) said nucleotide sequence has been or is determined as having a cumulative human allele frequency of less than 50% and/or having a total human genotype frequency of less than 50%.

5. The method of paragraph 3 or 4, wherein said human has been or is genotyped as positive for said variant nucleotide sequence before step (a).

6. The method of any preceding paragraph, wherein the human has been or is phenotyped as positive for said TOI variant before step (a).

7. The method of any preceding paragraph, wherein said frequency is less than 10 or 15%.

8. The method of any preceding paragraph, wherein the ligand is capable of binding to two or more different TOI variants, each being encoded by a nucleotide sequence having a cumulative human allele frequency of less than 50% and/or having a total human genotype frequency of less than 50%.

9. A method of treating or preventing a disease or condition in a human, wherein the disease or condition is mediated by a Target of Interest (TOI), wherein the TOI is present in humans as different polymorphic variants, the method comprising
a. Administering to the human an anti-TOI ligand to target a TOI variant in the human and treat or prevent said disease or condition, wherein the TOI in said human is a variant encoded by a nucleotide sequence having a cumulative human allele frequency of more than 50% and/or having a total human genotype frequency of more than 50%;
wherein
b. Before step (a) said human has been or is genotyped as negative for a variant nucleotide sequence having a cumulative human allele frequency of less than 50% and/or having a total human genotype frequency of less than 50%; or phenotyped as negative for a TOI variant encoded by a nucleotide sequence having a cumulative human allele frequency of less than 50% and/or having a total human genotype frequency of less than 50%.

10. The method of paragraph 9, wherein before step (a), the human has been or is phenotyped as positive for the most frequent TOI variant or genotyped for the nucleotide sequence thereof.

11. The method of paragraph 9 or 10, wherein before step (a) the ligand has been or is determined as being capable of binding to the most frequent TOI variant.

12. The method of paragraph 9, 10 or 11, wherein before step (a) the ligand has been or is determined as being substantially incapable of neutralising or inhibiting said TOI variant recited in step (b).

13. The method of any one of paragraphs 9 to 12, wherein the ligand is capable of binding to the most frequent TOI variant.

14. The method of any one of paragraphs 9 to 13, wherein the ligand is capable of binding to two or more different TOI variants, each being encoded by a nucleotide sequence having a cumulative human allele frequency of more than 50%.

15. The method of any preceding paragraph, wherein said variant nucleotide sequence recited in step (a) has been or is determined as being present in at least 2 different human ethnic populations.

16. The method of any preceding paragraph, wherein said human frequency is the frequency in a database of naturally-occurring sequences sampled from at least 15 different human ethnic populations and comprising at least 1000 sequences.

17. An anti-human TOI ligand for use in a method of treating and/or preventing a TOI-mediated disease or condition in a human, wherein the TOI is present in humans as different polymorphic variants and wherein the genome of said human comprises a TOI nucleotide sequence having a cumulative human allele frequency of less than 50% and/or a total human genotype frequency of less than 50%, the method comprising administering the ligand to the human.

18. The ligand of paragraph 17, wherein the ligand has been or is determined as capable of binding the human TOI encoded by said nucleotide sequence.

19. A ligand that binds a human TOI comprising an amino acid sequence encoded by a TOI nucleotide sequence having a cumulative human allele frequency of less than 50% and/or a total human genotype frequency of less than 50%, for use in a method comprising the step of using the ligand to target said TOI in a human to treat and/or prevent a disease or condition mediated by TOI, the method comprising administering the ligand to the human.

20. The ligand of any one of paragraphs 17 to 19, wherein the human has been or is genotyped as positive for said TOI nucleotide sequence having a cumulative human allele frequency of less than 50%.

The ligand of any one of paragraphs 17 to 19, wherein the human has been or is genotyped as positive for said TOI nucleotide sequence having a total human genotype frequency of less than 50%.

21. The ligand of any one of paragraphs 17 to 20, wherein the human has been or is phenotyped as positive for a TOI encoded by a nucleotide sequence having a cumulative human allele frequency of less than 50% and/or having a total human genotype frequency of less than 50%.

22. The ligand of any one of paragraphs 17 to 21, wherein the human has been or is genotyped as heterozygous for a TOI nucleotide sequence having a cumulative human allele frequency of less than 50% and/or having a total human genotype frequency of less than 50%; optionally wherein the human has been or is genotyped as comprising a TOI nucleotide sequence having a cumulative human allele frequency of less than 50% and a TOI nucleotide sequence having a cumulative human allele frequency of more than 50% and/or having a total human genotype frequency of more than 50%.

23. The ligand of any one of paragraphs 17 to 22, wherein the genome of the human has been or is genotyped as homozygous for a TOI nucleotide sequence having a cumulative human allele frequency of less than 50% and/or having a total human genotype frequency of less than 50%.

24. The ligand of any one of paragraphs 17 to 23, wherein the ligand comprises an antibody binding site that binds a human TOI comprising an amino acid sequence encoded by a TOI nucleotide sequence having a cumulative human allele frequency of less than 50% and/or having a total human genotype frequency of less than 50%; and optionally has been or is determined as capable of such binding.

25. The ligand of paragraph 24, wherein the ligand is an antibody or antibody fragment.

26. The ligand of any one of paragraphs 17 to 23, wherein the ligand comprises a nucleotide sequence that specifically hybridises to a TOI nucleotide sequence having a cumulative human allele frequency of less than 50% and/or having a total human genotype frequency of less than 50% or an RNA transcript thereof; and/or the ligand comprises a nucleotide sequence that comprises at least 10 contiguous nucleotides of a nucleotide sequence having a cumulative human allele frequency of less than 50% and/or having a total human genotype frequency of less than 50% or is an antisense sequence thereof.

27. The ligand of any one of paragraphs 17 to 26, wherein the genome of said human comprises a nucleotide sequence having a cumulative human allele frequency of less than 50% and the sequence is found in at least 2 different ethnic populations.

28. A pharmaceutical composition or kit for treating or preventing a condition or disease mediated by a TOI as recited in any preceding paragraph, the composition or kit comprising a ligand of any one of paragraphs 17 to 27; and optionally in combination with a label or instructions for use to treat and/or prevent said disease or condition in a human; optionally wherein the label or instructions comprise a marketing authorisation number (eg, an FDA or EMA authorisation number); optionally wherein the kit comprises an injection pen or IV container that comprises the ligand.

29. A method of producing an anti-human TOI antibody binding site, the method comprising obtaining a plurality of anti-TOI antibody binding sites, screening the antibody binding sites for binding to a TOI comprising an amino acid sequence encoded by a nucleotide sequence having a cumulative human allele frequency of less than 50% and/or a total human genotype frequency of less than 50%, or to a peptide thereof that comprises an amino acid variation from the corresponding sequence encoded by the TOI-encoding nucleotide sequence having the highest cumulative human allele frequency and/or the highest total human genotype frequency, and isolating an antibody binding site that binds in the screening step.

30. A method of producing an anti-human TOI antibody, the method comprising immunising a non-human vertebrate (eg, a mouse or a rat) with a TOI comprising an amino acid sequence encoded by a nucleotide sequence having a cumulative human allele frequency of less than 50% and/or a total human genotype frequency of less than 50%, or to a peptide thereof that comprises an amino acid variation from the corresponding sequence encoded by the TOI-encoding nucleotide sequence having the highest cumulative human allele frequency and/or the highest total human genotype frequency, and isolating an antibody that binds a TOI comprising an amino acid sequence encoded by a TOI nucleotide sequence having a cumulative human allele frequency of less than 50% and/or a total human genotype frequency of less than 50%, and optionally producing a TOI-binding fragment or derivative of the isolated antibody.

31. The method of paragraph 29 or 30, comprising the step of obtaining a nucleic acid encoding the antibody, fragment, derivative or binding site and optionally inserting the nucleic acid in an expression vector.

32. A kit for TOI genotyping a human, wherein the kit comprises a nucleic acid comprising a nucleotide sequence that specifically hybridises to a TOI nucleotide sequence selected having a cumulative human allele frequency of less than 50% and/or a total human genotype frequency of less than 50% or an RNA transcript thereof and/or the nucleic acid comprises a nucleotide sequence that comprises at least 10 contiguous nucleotides of a TOI nucleotide sequence having a cumulative human allele frequency of less than 50% and/or a total human genotype frequency of less than 50% or is an antisense sequence thereof.

33. A kit for TOI genotyping or phenotyping a human, wherein the kit comprises a ligand according to any one of paragraphs 17 to 27 or an antibody, fragment or derivative produced by the method of any one of paragraphs 29 to 31.

34. Use of an anti-TOI ligand that binds a human TOI comprising an amino acid sequence encoded by a TOI nucleotide sequence having a cumulative human allele frequency of less than 50% and/or a total human genotype frequency of less than 50%, in the manufacture of a medicament for treating and/or preventing a TOI-mediated disease or condition in a human whose genome comprises a TOI nucleotide sequence having a cumulative human allele frequency of less than 50% and/or having a total human genotype frequency of less than 50%.

35. Use of an anti-TOI ligand that binds a human TOI comprising an amino acid sequence encoded by a TOI nucleotide sequence having a cumulative human allele frequency of less than 50% and/or a total human genotype frequency of less than 50%, in the manufacture of a medicament for targeting said TOI in a human to treat and/or prevent a disease or condition mediated by TOI.

36. A method of targeting a TOI for treating and/or preventing a TOI-mediated disease or condition in a human, the method comprising administering an anti-TOI ligand to a human comprising a TOI nucleotide sequence selected having a cumulative human allele frequency of less than 50% and/or a total human genotype frequency of less than 50%, whereby a TOI encoded by said nucleotide sequence is targeted.

37. The method of paragraph 36, wherein the method comprises targeting a human TOI comprising an amino acid sequence with said ligand to treat and/or prevent said disease or condition in said human, wherein said amino acid sequence is encoded by a nucleotide sequence having a cumulative human allele frequency of less than 50% and/or a total human genotype frequency of less than 50%.

38. A method of TOI genotyping a nucleic acid sample of a human, the method comprising identifying in the sample the presence of a TOI nucleotide sequence having a cumulative human allele frequency of less than 50% and/or having a total human genotype frequency of less than 50%.

39. A method of TOI typing a protein sample of a human, the method comprising identifying in the sample the presence of a TOI amino acid sequence encoded by a TOI nucleotide sequence having a cumulative human allele frequency of less than 50% and/or having a total human genotype frequency of less than 50%.

40. The method of paragraph 38 or 39, comprising obtaining a sample of serum, blood, feces, hair, urine or saliva from a human, whereby the nucleic acid or protein sample is obtained for use in the step of identifying said sequence.

41. The method of any one of paragraphs 38 to 40, comprising using a ligand according to any one of paragraphs 17 to 27 to carry out said identifying step.

42. A diagnostic kit comprising a ligand that is capable of binding a human TOI comprising an amino acid sequence encoded by a TOI nucleotide sequence having a cumulative human allele frequency of less than 50% and/or a total human genotype frequency of less than 50% and instructions for carrying out the method of paragraph 38 or 39.

43. A diagnostic kit comprising a nucleic acid probe comprising a nucleotide sequence that specifically hybridises a TOI nucleotide sequence having a cumulative human allele frequency of less than 50% and/or a total human genotype frequency of less than 50% or an RNA transcript thereof and instructions for carrying out the method of paragraph 38 or 39.

44. The method, ligand, composition, kit or use of any preceding paragraph, wherein the TOI is encoded by a nucleotide sequence having a cumulative human allele frequency from 1 to 10% and/or a total human genotype frequency from 1 to about 15% or from 1 to 15%.

45. The method, ligand, composition, kit or use of any preceding paragraph wherein the TOI is a human TOI selected from Table 5; optionally for treating and/or preventing a corresponding disease or condition as set out in table 5.

46. The ligand, method, use, kit or composition of any preceding paragraph, wherein
    (i) the ligand (eg, antibody or fragment) comprises
        (e) a variable domain that is encoded by a human V region nucleotide sequence, wherein the V nucleotide sequence is derived from recombination of human VH, D and JH gene segments or human VL and JL gene segments; or
        (f) a constant region domain encoded by a C region gene segment;
        Wherein a first gene segment of said gene segments of (a), or said C region gene segment of (b) comprises a first single nucleotide polymorphism (SNP) encoding a first amino acid polymorphism; and
    (ii) the genome of said human comprises said first SNP or wherein said human expresses (a') an antibody variable domain comprising said first amino acid polymorphism or (b') an antibody constant domain comprising said first amino acid polymorphism.

47. The ligand, method, use, kit or composition of paragraph 46, wherein blood of said human comprises substantially no antibodies that specifically bind to the domain comprising said first amino acid polymorphism as determined in an in vitro binding assay.

48. The ligand, method, use, kit or composition of paragraph 47, wherein SPR is used to carry out said assay.

49. The ligand, method, use, kit or composition of any one of paragraphs 46 to 48, wherein the genome of said human comprises said first gene segment (when (a) applies) or said C region gene segment (when (b) applies).

50. The ligand, method, use, kit or composition of any one of paragraphs 46 to 49, wherein said first segment or a second segment of said segments of (a), or said C region gene segment of (b), comprises a second SNP encoding a second amino acid polymorphism; and wherein the genome of said human comprises said second SNP or wherein said human expresses (a") an antibody variable domain comprising said second amino acid polymorphism or (b") an antibody constant region domain comprising said first and second amino acid polymorphisms.

51. The ligand, method, use, kit or composition of paragraph 50, wherein said human expresses an antibody variable domain comprising said first and second amino acid polymorphisms.

52. The ligand, method, use, kit or composition of paragraph 50 or 51, wherein the first and second SNPs of said genome are comprised by the same antibody gene segment.

53. The ligand, method, use, kit or composition of any one of paragraphs 46 to 52, wherein each SNP is a variable region gene segment SNP.

54. The ligand, method, use, kit or composition of any one of paragraphs 46 to 52, wherein each SNP is a constant region gene segment SNP, eg each SNP is a gamma-1 constant region gene segment SNP, or a gamma-2 constant region gene segment SNP, or a gamma-3 constant region gene segment SNP or a gamma-4 constant region gene segment SNP.

55. The ligand, method, use, kit or composition of paragraph 54, wherein the first SNP is a CH1, CH2, CH3 or CH4 gene segment SNP and/or the second SNP is a CH1, CH2, CH3 or CH4 gene segment SNP.

56. The ligand, method, use, kit or composition of any one of paragraphs 46 to 53, wherein each SNP is a variable domain SNP, eg, a VH domain SNP, or a Vκ domain SNP, or a Vλ SNP.

57. The ligand, method, use, kit or composition of any one of paragraphs 46 to 56, wherein said constant region domain of (b) is comprised by an antibody Fc region.

58. The ligand, method, use, kit or composition of any one of paragraphs 46 to 57, wherein the ligand (eg, antibody or fragment) has been determined to specifically bind one or more human TOI variants as disclosed herein, for example, with a KD of 1 nM or less (eg, 100 or 10 pM or less) as determined by SPR.

59. The ligand, method, use, kit or composition of any preceding paragraph (eg, according to any one of paragraphs 46 to 58), wherein the ligand comprises or consists of an antibody or fragment that comprises a human antibody variable domain derived from the recombination of a human V gene segment and a human J gene segment (and optionally a human D gene segment when the variable domains are VH domains); and wherein the genome of the human comprises said human V gene segment and/or the human expresses antibodies comprising antibody variable domains derived from the recombination of said human V gene segment and a human J gene segment (and optionally a human D gene segment).

60. The ligand, method, use, kit or composition of any preceding paragraph (eg, according to any one of paragraphs 46 to 59), wherein the ligand (eg, comprising or consisting of an antibody or fragment or an Fc-fused human TOI receptor) comprises a human heavy chain constant domain encoded by a first constant region nucleotide sequence; and wherein the genome of the human comprises a heavy chain constant region nucleotide sequence that is identical to said first constant region nucleotide sequence and/or the human expresses antibodies comprising said human constant domain.

61. The ligand, method, use, kit or composition of any preceding paragraph (eg, according to any one of paragraphs 46 to 60), wherein the ligand (eg, comprising or consisting of an antibody or fragment or an Fc-fused human TOI receptor) comprises a human gamma heavy chain CH1 domain encoded by a CH1 nucleotide sequence; and wherein the genome of the human comprises a gamma heavy chain constant region nucleotide sequence that is identical to said CH1 nucleotide sequence and/or the human expresses antibodies comprising said human gamma CH1 domain.

62. The ligand, method, use, kit or composition of any preceding paragraph (eg, according to any one of paragraphs 46 to 61), wherein the ligand (eg, comprising or consisting of an antibody or fragment or an Fc-fused human TOI receptor) comprises a human gamma heavy chain CH2 domain encoded by a CH2 nucleotide sequence; and wherein the genome of the human comprises a gamma heavy chain constant region nucleotide sequence that is identical to said CH2 nucleotide sequence and/or the human expresses antibodies comprising said human gamma CH2 domain.

63. The ligand, method, use, kit or composition of any preceding paragraph (eg, according to any one of paragraphs 46 to 62), wherein, wherein the ligand (eg, comprising or consisting of an antibody or fragment or an Fc-fused human TOI receptor) comprises a human gamma heavy chain CH3 domain encoded by a CH3 nucleotide sequence; and wherein the genome of the human comprises a gamma heavy chain constant region nucleotide sequence that is identical to said CH3 nucleotide sequence and/or the human expresses antibodies comprising said human gamma CH3 domain.

64. The ligand, method, use, kit or composition of any preceding paragraph (eg, according to any one of paragraphs 46 to 63), wherein the ligand (eg, comprising or consisting of an antibody or fragment or an Fc-fused human TOI receptor) comprises a human gamma heavy chain CH4 domain encoded by a CH4 nucleotide sequence; and wherein the genome of the human comprises a gamma heavy chain constant region nucleotide sequence that is identical to said CH4 nucleotide sequence and/or the human expresses antibodies comprising said human gamma CH4 domain.

65. The ligand, method, use, kit or composition of any preceding paragraph (eg, according to any one of paragraphs 46 to 64), wherein the ligand (eg, comprising or consisting of an antibody or fragment or an Fc-fused human TOI receptor) comprises a human gamma heavy chain Fc region encoded by a Fc nucleotide sequence; and wherein the genome of the human comprises a gamma heavy chain constant region nucleotide sequence that is identical to said Fc nucleotide sequence and/or the human expresses antibodies comprising said human gamma Fc region.

66. The ligand, method, use, kit or composition of any one of paragraphs 61 to 65, wherein said human gamma heavy chain is a human gamma-1 heavy chain.

67. The ligand, method, use, kit or composition of any one of paragraphs 61 to 65, wherein said human gamma heavy chain is a human gamma-2 heavy chain.

68. The ligand, method, use, kit or composition of any one of paragraphs 61 to 65, wherein ligand comprises a human IGHG1*01 gamma-1 heavy chain constant region.

69. The ligand, method, use, kit or composition of any one of paragraphs 61 to 65, wherein ligand comprises a human IGHG2*01 gamma-1 heavy chain constant region.

70. The ligand, method, use, kit or composition of any one of paragraphs 60 to 69, wherein the human has been or is genotyped as positive for said heavy chain constant region nucleotide sequence.

71. The ligand, method, use, kit or composition of paragraph 68, wherein the human has been or is genotyped as positive for human IGHG1*01 nucleotide sequence.

72. The ligand, method, use, kit or composition of paragraph 69, wherein the human has been or is genotyped as positive for human IGHG2*01 nucleotide sequence.

73. The ligand, method, use, kit or composition of any one of paragraphs 61 to 69, wherein the human has been or is phenotyped as positive for said gamma heavy chain constant domain, CH1, CH2, CH3, CH4 or Fc.

74. The ligand, method, use, kit or composition of paragraph 63, (i) when dependent from clause 23, wherein the human has been or is phenotyped as positive for a human IGHG1*01 gamma heavy chain constant domain, CH1, CH2, CH3, CH4 or Fc or (ii) when dependent from clause 24, wherein the human has been phenotyped as positive for a human IGHG2*01 gamma heavy chain constant domain, CH1, CH2, CH3, CH4 or Fc.

75. The method or use of any one of paragraphs 61 to 69 and 71 to 74, comprising genotyping the human as positive for said gamma heavy chain constant region nucleotide sequence, eg, positive for said gamma heavy chain constant domain, CH1, CH2, CH3, CH4 or Fc nucleotide sequence; positive for said human IGHG1*01 gamma heavy chain constant region, CH1, CH2, CH3, CH4 or Fc nucleotide sequence; or positive for said human IGHG2*01 gamma heavy chain constant region, CH1, CH2, CH3, CH4 or Fc nucleotide sequence.

76. The method or use of any one of paragraphs 61 to 69 and 71 to 75, comprising phenotyping the human as positive for said gamma heavy chain constant region, eg, positive for said gamma heavy chain constant domain, CH1, CH2, CH3, CH4 or Fc; positive for said human IGHG1*01 gamma heavy chain constant domain, CH1, CH2, CH3, CH4 or Fc; or positive for said human IGHG2*01 gamma heavy chain constant domain, CH1, CH2, CH3, CH4 or Fc.

77. The ligand, method, use, kit or composition of any preceding paragraph (eg, according to any one of clauses 46 to 76), wherein the ligand (eg, comprising or consisting of an antibody or fragment or an Fc-fused TOI receptor) comprises a human gamma-1 heavy chain constant region that comprises an Asp corresponding to position 204 of SEQ ID NO: 42 or a Leu corresponding to position 206 of SEQ ID NO: 42 and wherein the genome of the human comprises a gamma-1 heavy chain constant region nucleotide sequence that encodes such an Asp or Leu or the human expresses antibodies comprising human gamma-1 constant regions comprising such an Asp or Leu.

78. The ligand, method, use, kit or composition of paragraph 77, wherein the ligand comprises a human gamma-1 heavy chain constant region that comprises an Asp corresponding to position 204 of SEQ ID NO: 42 and a Leu corresponding to position 206 of SEQ ID NO: 42.

79. The ligand, method, use, kit or composition of paragraph 77 or 78, wherein the genome of the human comprises a gamma-1 heavy chain constant region nucleotide sequence that encodes such an Asp and Leu or the human expresses antibodies comprising human gamma-1 constant regions comprising such an Asp and Leu.

80. The ligand, method, use, kit or composition of paragraph 77, 78 or 79, wherein the ligand comprises a human IGHG1*01 gamma-1 heavy chain constant region, eg, an Fc, CH1, CH2 and/or CH3 domain encoded by human IGHG1*01.

81. The ligand, method, use, kit or composition of any one of paragraphs 77 to 80, wherein the genome of the human comprises a human IGHG1*01 nucleotide sequence or the human expresses antibodies comprising human constant domains encoded by a human IGHG1*01 nucleotide sequence.

82. The ligand, method, use, kit or composition of any one of paragraphs 77 to 81, wherein the ligand comprises a hinge region encoded by human IGHG1*01.

83. The ligand, method, use, kit or composition of any one of paragraphs 77 to 82, wherein the ligand comprises or consists of an antibody, wherein the antibody comprises heavy chains that comprise SEQ ID NO: 61.

84. The ligand, method, use, kit or composition of any one of paragraphs 77 to 83, wherein the human is of European ancestry.

85. The ligand, method, use, kit or composition of any one of paragraphs 77 to 84, wherein the human has been or is genotyped as positive for said Asp and/or Leu.
86. The ligand, method, use, kit or composition of any one of paragraphs 77 to 85, wherein the human has been or is genotyped as positive for human IGHG1*01.
87. The ligand, method, use, kit or composition of any one of paragraphs 77 to 86, wherein the human has been or is phenotyped as positive for a human IGHG1*01 CH3.
88. The method or use of any one of paragraphs 77 to 87, comprising selecting a said human whose genome comprises a codon(s) encoding said Asp and/or Leu; comprises human IGHG1*01; or comprises a human IGHG1*01 CH3.
89. The method or use of any one of paragraphs 77 to 88, comprising selecting a said human whose phenotype comprises said Asp and/or Leu; a human IGHG1*01 region; or a human IGHG1*01 CH3.
90. The ligand, method, use, kit or composition of any preceding paragraph, wherein the ligand (eg, comprising or consisting of an antibody or fragment or an Fc-fused TOI receptor) comprises a human gamma-2 heavy chain constant region that comprises an amino acid selected from the group consisting of a Pro corresponding to position 72 of SEQ ID NO: 44, an Asn corresponding to position 75 of SEQ ID NO: 44, a Phe corresponding to position 76 of SEQ ID NO: 44, a Val corresponding to position 161 of SEQ ID NO: 44 and an Ala corresponding to position 257 of SEQ ID NO: 44; and wherein the genome of the human comprises a gamma-2 heavy chain constant region nucleotide sequence that encodes such a selected amino acid or the human expresses antibodies comprising human gamma-2 constant regions comprising such a selected amino acid.
91. The ligand, method, use, kit or composition of paragraph 90, wherein the ligand comprises a human gamma-2 heavy chain constant region that comprises (i) a Pro corresponding to position 72 of SEQ ID NO: 44, an Asn corresponding to position 75 of SEQ ID NO: 44, a Phe corresponding to position 76 of SEQ ID NO: 44 and optionally (ii) a Val corresponding to position 161 of SEQ ID NO: 44 and/or an Ala corresponding to position 257 of SEQ ID NO: 44; and wherein the genome of the human comprises a gamma-2 heavy chain constant region nucleotide sequence that encodes such amino acids of (i) or the human expresses antibodies comprising human gamma-2 constant regions comprising such amino acids of (i).
92. The ligand, method, use, kit or composition of paragraph 90 or 91, wherein the ligand comprises a human gamma-2 heavy chain constant region that comprises (i) a Val corresponding to position 161 of SEQ ID NO: 44 and an Ala corresponding to position 257 of SEQ ID NO: 44 and optionally (ii) an amino acid selected from the group consisting of a Pro corresponding to position 72 of SEQ ID NO: 44, an Asn corresponding to position 75 of SEQ ID NO: 44 and a Phe corresponding to position 76 of SEQ ID NO: 44; and wherein the genome of the human comprises a gamma-2 heavy chain constant region nucleotide sequence that encodes such amino acids of (i) or the human expresses antibodies comprising human gamma-2 constant regions comprising such amino acids of (i).
93. The ligand, method, use, kit or composition of any one of paragraph 90 to 92, wherein the ligand comprises a human IGHG2*01 gamma-2 heavy chain constant region, eg, an Fc, CH1, CH2 and/or CH3 domain encoded by human IGHG2*01.
94. The ligand, method, use, kit or composition of any one of paragraphs 90 to 93, wherein the genome of the human comprises a human IGHG2*01 nucleotide sequence or the human expresses antibodies comprising human constant domains encoded by a human IGHG2*01 nucleotide sequence.
95. The ligand, method, use, kit or composition of any one of paragraphs 90 to 94, wherein the ligand comprises a hinge region encoded by human IGHG2*01.
96. The ligand, method, use, kit or composition of any one of paragraphs 90 to 95, wherein the ligand comprises or consists of an antibody, wherein the antibody comprises heavy chains that comprise SEQ ID NO: 63 or 65.
97. The ligand, method, use, kit or composition of any one of paragraphs 90 to 96, wherein the human is of European, African American, or European American ancestry.
98. The ligand, method, use, kit or composition of any one of paragraphs 90 to 97, wherein the human has been or is genotyped as positive for one, more or all of said Pro, Asn, Phe, Val and Ala.
99. The ligand, method, use, kit or composition of any one of paragraphs 90 to 98, wherein the human has been or is genotyped as positive for human IGHG2*01.
100. The ligand, method, use, kit or composition of any one of paragraphs 90 to 99, wherein the human has been or is phenotyped as positive for a human IGHG2*01 CH1.
101. The ligand, method, use, kit or composition of any one of paragraphs 90 to 100, wherein the human has been or is phenotyped as positive for a human IGHG2*01 CH2.
102. The ligand, method, use, kit or composition of any one of paragraphs 90 to 101, wherein the human has been or is phenotyped as positive for a human IGHG2*01 CH3.
103. The method or use of any one of paragraphs 90 to 102, comprising selecting a said human whose genome comprises a codon(s) encoding one, more or all of said Pro, Asn, Phe, Val and Ala; comprises human IGHG2*01; or comprises a human IGHG2*01 CH1, CH2 and/or CH3.
104. The method or use of any one of paragraphs 90 to 103, comprising selecting a said human whose phenotype comprises one, more or all of said Pro, Asn, Phe, Val and Ala; a human IGHG2*01 region; or a human IGHG2*01 CH1, CH2 and/or CH3.
105. The ligand, method, use, kit or composition of any one of paragraphs 90 to 104, wherein the human expresses antibodies comprising human gamma-2 constant regions comprising such a Pro, Asn, Phe, Val and Ala.
106. The ligand, method, use, kit or composition of any preceding paragraph, wherein the ligand (eg, comprising or consisting of an antibody or fragment or an Fc-fused TOI receptor) comprises a human kappa light chain constant region that comprises a Val corresponding to position 84 of SEQ ID NO: 50 or a Cys corresponding to position 87 of SEQ ID NO: 50; and wherein the genome of the human comprises a kappa light chain constant region nucleotide sequence that encodes such a Val or Cys or the human expresses antibodies comprising human kappa light chain constant regions comprising such a Val or Cys.
107. The ligand, method, use, kit or composition of paragraph 106, wherein the ligand comprises a human kappa light chain constant region that comprises a Val corresponding to position 84 of SEQ ID NO: 50 and a Cys corresponding to position 87 of SEQ ID NO: 50.
108. The ligand, method, use, kit or composition of paragraph 106 or 107, wherein the genome of the human comprises a kappa light chain constant region nucleotide sequence that encodes such a Val and Cys or the human expresses antibodies comprising human kappa constant regions comprising such a Val and Cys.

109. The ligand, method, use, kit or composition of any one of paragraphs 106 to 108, wherein the antibody or fragment comprises a human IGKC*01 kappa light chain constant region.

110. The ligand, method, use, kit or composition of any one of paragraphs 106 to 109, wherein the ligand comprises or consists of an antibody, wherein the antibody comprises light chains that comprise SEQ ID NO: 62 or 66.

111. The ligand, method, use, kit or composition of any one of paragraphs 106 to 110, wherein the ligand comprises or consists of an antibody, wherein the antibody comprises a light chain variable domain derived from recombination of a human Vκ gene segment and a human Jκ gene segment, wherein the Jκ gene segment is IGKJ2*01 (SEQ ID NO: 57).

112. The ligand, method, use, kit or composition of any one of paragraphs 106 to 111, wherein the human has been or is phenotyped as positive for said Val and/or Cys.

113. The ligand, method, use, kit or composition of any one of paragraphs 106 to 112, wherein the human has been or is genotyped as positive for human IGKC*01.

114. The ligand, method, use, kit or composition of any one of paragraphs 106 to 113, wherein the human has been or is phenotyped as positive for a human IGKC*01 domain.

115. The method or use of any one of paragraphs 106 to 114, comprising selecting a said human whose genome comprises a codon(s) encoding said Val and/or Cys; or comprises human IGKC*01.

116. The method or use of any one of paragraphs 106 to 115, comprising selecting a said human whose phenotype comprises such a Val and/or Cys; or comprises a human IGKC*01 domain.

117. The ligand, method, use, kit or composition of any one of paragraphs 106 to 116, wherein the human expresses antibodies comprising human kappa constant domains comprising such a Val and Cys, eg, expresses human IGKC*01 constant domains.

118. The ligand, method, use, kit or composition of any preceding paragraph, wherein the ligand (eg, comprising or consisting of an antibody or fragment or an Fc-fused TOI receptor) comprises a human IGLC2*01 light chain constant region; and wherein the genome of the human comprises a human IGLC2*01 nucleotide sequence or the human expresses antibodies comprising human light chain IGLC2*01 constant regions.

119. The ligand, method, use, kit or composition of paragraph 118, wherein the antibody comprises light chains that comprise SEQ ID NO: 64.

120. The ligand, method, use, kit or composition of paragraph 118 or 119, wherein the human has been or is genotyped as positive for human IGLC2*01.

121. The ligand, method, use, kit or composition of any one of paragraphs 118 to 120, wherein the human has been or is phenotyped as positive for a human IGLC2*01 domain.

122. The method or use of any one of paragraphs 118 to 212, comprising selecting a said human whose genome comprises human IGLC2*01.

123. The method or use of any one of clauses 73 to 77, comprising selecting a said human whose phenotype comprises a human IGLC2*01 domain.

124. The ligand, method, use, kit or composition of any one of paragraphs 108 to 123, wherein the human expresses antibodies comprising human lambda IGLC2*01 constant domains.

125. The ligand, method, use, kit or composition of any preceding paragraph, wherein the ligand comprises or consists of an antibody or fragment, wherein the antibody or fragment comprises a VH domain that is derived from the recombination of a human VH gene segment, a human D gene segment and a human JH gene segment, wherein the VH gene segment is selected from the group consisting of (i) IGHV1-18*01 and the genome of the human comprises a human IGHV1-18*01 nucleotide sequence or the human expresses antibodies comprising variable domains derived from the recombination of human IGHV1-18*01; or (ii) IGVH1-46*01 and the genome of the human comprises a human IGHV1-46*01 nucleotide sequence or the human expresses antibodies comprising variable domains derived from the recombination of human IGHV1-46*01.

126. The ligand, method, use, kit or composition of paragraph 125, wherein the antibody or fragment comprises a one more or all of a CH1 domain, CH2 domain, CH3 domain, hinge or Fc encoded by human IGHG2*01.

127. The ligand, method, use, kit or composition of paragraph 125 or 126, wherein the antibody or fragment comprises heavy chains that comprise SEQ ID NO: 63 or 65.

128. The ligand, method, use, kit or composition of any one of paragraphs 125 to 127, wherein the human has been or is genotyped as positive for said selected VH gene segment, positive for human IGHV1-18*01 or IGVH1-46*01.

129. The method or use of any of paragraphs 125 to 128, comprising genotyping the human as positive for said selected VH gene segment, eg, positive for human IGHV1-18*01 or IGVH1-46*01.

130. The ligand, method, use, kit or composition any preceding paragraph, wherein the ligand comprises or consists of an antibody or fragment, wherein the antibody or fragment comprises a VL domain that is derived from the recombination of a human VL gene segment and a human JL gene segment, wherein the VL gene segment is selected from the group consisting of (i) IGKV4-1*01 and the genome of the human comprises a human IGKV4-1*01 nucleotide sequence or the human expresses antibodies comprising variable domains derived from the recombination of human IGKV4-1*01; (ii) IGLV2-14*01 and the genome of the human comprises a human IGLV2-14*01 nucleotide sequence or the human expresses antibodies comprising variable domains derived from the recombination of human IGLV2-14*01; or (iii) IGKV1-13*02 and the genome of the human comprises a human IGKV1-13*02 nucleotide sequence or the human expresses antibodies comprising variable domains derived from the recombination of human IGKV1-13*02.

131. The ligand, method, use, kit or composition of paragraph 130, wherein the antibody comprises light chains that comprise SEQ ID NO: 62, 64 or 66.

132. The ligand, method, use, kit or composition of paragraph 130 or 131, wherein the antibody or fragment comprises a light chain variable domain derived from recombination of a human Vκ gene segment and a human Jκ gene segment, wherein the Jκ gene segment is IGKJ2*01 (SEQ ID NO: 57; wherein (i) or (iii) applies.

133. The ligand, method, use, kit or composition of any one of paragraphs 130 to 132, wherein the human has been or is genotyped as positive for said selected VL gene segment, eg, positive for human IGKV4-1*01, IGLV2-14*01 or IGKV1-13*02.

134. The method or use of paragraph 133, comprising genotyping the human as positive for said selected VL gene segment, eg, genotyping the human as positive for human IGKV4-1*01, IGLV2-14*01 or IGKV1-13*02.

135. The ligand, method, use, kit or composition of any preceding paragraph, wherein the ligand (eg, antibody or fragment) binds said human TOI with a dissociation constant (Kd) of 1 nM or less as determined by SPR, (eg, 100, 10 or 1 pM or less).
136. The ligand, method, use, kit or composition of any preceding paragraph, wherein the TOI is human PCSK9 or human IL-6R.

EXAMPLES

Example 1

Rare PCSK9 Variants

Proprotein convertase subtilisin kexin type 9 (PCSK9) is a serine protease involved in regulating the levels of the low density lipoprotein receptor (LDLR) protein (Horton et al., 2007; Seidah and Prat, 2007). In vitro experiments have shown that adding PCSK9 to HepG2 cells lowers the levels of cell surface LDLR (Benjannet et al., 2004; Lagace et al., 2006; Maxwell et al., 2005; Park et al., 2004). Experiments with mice have shown that increasing PCSK9 protein levels decreases levels of LDLR protein in the liver (Benjannet et al., 2004; Lagace et al., 2006; Maxwell et al., 2005; Park et al., 2004), while PCSK9 knockout mice have increased levels of LDLR in the liver (Rashid et al., 2005). Additionally, various human PCSK9 mutations that result in either increased or decreased levels of plasma LDL have been identified (Kotowski et al., 2006; Zhao et al., 2006). PCSK9 has been shown to directly interact with the LDLR protein, be endocytosed along with the LDLR, and co-immunofluoresce with the LDLR throughout the endosomal pathway (Lagace et al., 2006).

PCSK9 is a prohormone-proprotein convertase in the subtilisin (S8) family of serine proteases (Seidah et al., 2003). Humans have nine prohormone-proprotein convertases that can be divided between the S8A and S8B subfamilies (Rawlings et al., 2006). Furin, PC1/PC3, PC2, PACE4, PC4, PC5/PC6 and PC7/PC8/LPC/SPC7 are classified in subfamily S8B. Crystal and NMR structures of different domains from mouse furin and PCI reveal subtilisin-like pro- and catalytic domains, and a P domain directly C-terminal to the catalytic domain (Henrich et al., 2003; Tangrea et al., 2002). Based on the amino acid sequence similarity within this subfamily, all seven members are predicted to have similar structures (Henrich et al., 2005). SKI-1/S1P and PCSK9 are classified in subfamily S8A. Sequence comparisons with these proteins also suggest the presence of subtilisin-like pro- and catalytic domains (Sakai et al., 1998; Seidah et al., 2003; Seidah et al., 1999). In these proteins the amino acid sequence C-terminal to the catalytic domain is more variable and does not suggest the presence of a P domain.

Prohormone-proprotein convertases are expressed as zymogens and they mature through a multi step process. The function of the pro-domain in this process is two-fold. The pro-domain first acts as a chaperone and is required for proper folding of the catalytic domain (Ikemura et al., 1987). Once the catalytic domain is folded, autocatalysis occurs between the pro-domain and catalytic domain. Following this initial cleavage reaction, the pro-domain remains bound to the catalytic domain where it then acts as an inhibitor of catalytic activity (Fu et al., 2000). When conditions are correct, maturation proceeds with a second autocatalytic event at a site within the pro-domain (Anderson et al., 1997). After this second cleavage event occurs the pro-domain and catalytic domain dissociate, giving rise to an active protease.

Autocatalysis of the PCSK9 zymogen occurs between Gln152 and Ser153 (VFAQ|SIP (SEQ ID NO: 116)) (Naureckiene et al., 2003), and has been shown to be required for its secretion from cells (Seidah et al., 2003). A second autocatalytic event at a site within PCSK9's pro-domain has not been observed. Purified PCSK9 is made up of two species that can be separated by non-reducing SDS-PAGE; the pro-domain at 17 Kd, and the catalytic plus C-terminal domains at 65 Kd. PCSK9 has not been isolated without its inhibitory pro-domain, and measurements of PCSK9's catalytic activity have been variable (Naureckiene et al., 2003; Seidah et al., 2003).

In certain embodiments, a PCSK9 polypeptide includes terminal residues, such as, but not limited to, leader sequence residues, targeting residues, amino terminal methionine residues, lysine residues, tag residues and/or fusion protein residues. "PCSK9" has also been referred to as FH3, NARC1, HCHOLA3, proprotein convertase subtilisin/kexin type 9, and neural apoptosis regulated convertase 1. The PCSK9 gene encodes a proprotein convertase protein that belongs to the proteinase K subfamily of the secretory subtilase family. The term "PCSK9" denotes both the proprotein and the product generated following autocatalysis of the proprotein. When only the autocatalyzed product is being referred to (such as for an antigen binding protein or ligand that binds to the cleaved PCSK9), the protein can be referred to as the "mature," "cleaved", "processed" or "active" PCSK9. When only the inactive form is being referred to, the protein can be referred to as the "inactive", "pro-form", or "unprocessed" form of PCSK9. The term PCSK9 also encompasses PCSK9 molecules incorporating post-translational modifications of the PCSK9 amino acid sequence, such as PCSK9 sequences that have been glycosylated, PCSK9 sequences from which its signal sequence has been cleaved, PCSK9 sequence from which its pro domain has been cleaved from the catalytic domain but not separated from the catalytic domain (see, e.g., FIGS. 1A and 1B of US20120093818A1; which is incorporated by reference herein in its entirety).

The present invention provides anti-PCSK9 ligands; and PCSK9-binding or targeting ligands as described herein. The ligands have a variety of utilities. Some of the ligands, for instance, are useful in specific binding assays, for genotyping or phenotyping humans, affinity purification of PCSK9, in particular human PCSK9 or its ligands and in screening assays to identify other antagonists of PCSK9 activity. Some of the ligands of the invention are useful for inhibiting binding of PCSK9 to LDLR, or inhibiting PCSK9-mediated activities.

Anti-PCSK9 ligands (eg, antibodies and anti-sense RNA) have been developed based on targeting and neutralising so-called "wild-type" human PCSK9, which is a commonly-occurring form (see, eg, US20120093818A1 and US20110065902A1; each of which is incorporated by reference herein in its entirety). While such therapies are useful for human patients harbouring this form of human PCSK9, the inventor considered it useful to investigate the possibility of targeting much rarer—but still naturally-occurring—forms of PCSK9 amongst human populations. In this way, the inventor arrived at insight into the natural occurrences and distributions of rarer human PCSK9 forms that can serve as useful targets (at the protein or nucleic acid level) for human treatment, prophylaxis and diagnosis pertinent to diseases and conditions mediated or associated with PCSK9 activity. This particularly provides for tailored therapies, prophylaxis and diagnosis in humans that are devoid of the common PCSK9 gene or protein (ie, the form a or a' as used in US20120093818A1 and US20110065902A1 to generate antibodies).

The skilled person will know that SNPs or other changes that translate into amino acid variation can cause variability in activity and/or conformation of human targets to be addressed. This has spawned great interest in personalized medicine where genotyping and knowledge of protein and nucleotide variability is used to more effectively tailor medicines and diagnosis of patients. The invention, therefore, provides for tailored pharmaceuticals and testing that specifically addresses rarer PCSK9 polymorphic variant forms. Such forms or "alleles" (at the nucleotide level), in many of the examples determined by the inventor, comprise multiple changes at the nucleotide and amino acid levels from the corresponding common form nucleotide and amino acids sequences, ie, there are multiple non-synonymous changes at the nucleotide level that translate into multiple corresponding changes in the protein target in humans.

Furthermore, the inventor surprisingly realised that the rarer natural forms, although present in humans at much lower frequencies than the common form, nevertheless are represented in multiple and ethnically-diverse human populations and usually with many human examples per represented ethnic population. Thus, the inventor realised that targeting such rarer forms would provide for effective treatment, prophylaxis or diagnosis across many human ethnic populations, thereby extending the utility of the present invention.

With this realisation, the inventor realised that there is significant industrial and medical application for the invention in terms of guiding the choice of anti-PCSK9 ligand for administration to human patients for therapy and/or prophylaxis of PCSK9-mediated or associated diseases or conditions. In this way, the patient receives drugs and ligands that are tailored to their needs—as determined by the patient's genetic or phenotypic makeup. Hand-in-hand with this, the invention provides for the genotyping and/or phenotyping of patients in connection with such treatment, thereby allowing a proper match of drug to patient. This increases the chances of medical efficacy, reduces the likelihood of inferior treatment using drugs or ligands that are not matched to the patient (eg, poor efficacy and/or side-effects) and avoids pharmaceutical mis-prescription and waste.

In developing this thinking, the present inventor decided to determine a set of human PCSK9 variants on the basis of the following criteria, these being criteria that the inventor realised would provide for useful medical drugs and diagnostics to tailored need in the human population. The inventor selected variants having at least 3 of the 4 following criteria:—

PCSK9 variants having a cumulative human allele frequency in the range from 1 to 10%;
PCSK9 variants having a total human genotype frequency in the range from 1 to about 15%;
PCSK9 variants found in many different human ethnic populations (using the standard categorisation of the 1000 Genomes Project, which is an accepted standard in the art; see Table 4 below); and
PCSK9 variants found in many individuals distributed across such many different ethnic populations.

On the basis of these criteria, the inventor identified the variants listed in Table 1 below (excluding form a).

The inventor's selection included, as a consideration, selection for nucleotide variation that produced amino acid variation in corresponding PCSK9 forms (ie, non-synonymous variations), as opposed to silent variations that do not alter amino acid residues in the target protein.

TABLE 1

Human PCSK9 variants distributed over several human ethnic populations & having a total human genotype frequency in the range of 1 to about 15%

(a) Amino acid variability, population distributions and frequency

| Form a | 46R | 53A | 425N | 443A | 474I | 619Q | 670E | ASW, YRI, GBR, TSI, CLM, CHB, LWK, CHS, MXL, JPT, PUR, IBS, FIN, CEU | 939 | 14 | 0.3951 | 0.4506 (0.8457) | 0.64815 |

| Variant Form | Amino Acid Position & Variation | | | | | | | Human Populations | No. Individs[1] | No. Unique Pops[2] | Het Freq[3] | Hom Freq[4] (Het + Hom freq[3]) | Cum Freq[5] |
|---|---|---|---|---|---|---|---|---|---|---|---|---|---|
| | 46L | 53V | 425S | 443T | 474V | 619P | 670G | | | | | | |
| f | | | | | | x | | ASW, YRI, GBR, TSI, CLM, LWK, MXL, JPT, PUR, IBS, FIN, CEU | 180 | 12 | 0.153 | 0.009 (0.162) | 0.0855 |
| c | | | | | | | x | ASW, YRI, GBR, TSI, CLM, CHB, LWK, CHS, JPT, PUR, FIN, CEU | 153 | 12 | 0.1296 | 0.0081 (0.1377) | 0.0729 |
| r | | | | | x | | x | | | | 0.0234 | 0.009 (0.0324) | 0.0292 |
| p | | x | | | x | | | ASW, GBR, TSI, CLM, JPT, PUR, IBS, FIN, CEU | 49 | 9 | 0.0441 | (0.0441) | 0.0221 |
| m | | | | x | | | | LWK, ASW, YRI, CLM | 29 | 4 | 0.0225 | (0.0225) | 0.0149 |
| e | | | x | | x | | | LWK, ASW, YRI | 15 | 3 | 0.0135 | (0.0135) | 0.0068 |
| h | | | | x | | x | | LWK, ASW, YRI | 10 | 3 | 0.009 | (0.009) | 0.0045 |
| aj | X | | | | x | | | PUR, TSI, FIN, CEU | 9 | 4 | 0.0081 | (0.0081) | 0.0041 |

TABLE 1-continued

Human PCSK9 variants distributed over several human ethnic populations & having a total human genotype frequency in the range of 1 to about 15%

| | | | | | | | | | |
|---|---|---|---|---|---|---|---|---|---|
| q | x | | | x | CHS, ASW, JPT, PUR, CHB | 7 | 5 | 0.0063 | (0.0063) | 0.0032 |

Table Footnotes:
"x" in a box indicates that the amino acid for the variant form is different from the amino acid at that position in form a, the variant amino acid being shown in "Amino Acid Position & Variation" of the table and the form a amino acid being shown in the first row of the table; amino acids at all other positions of each variant form are identical to those found in form a. Amino acid numbering is per the numbering shown for the pro-form in Table 2 below.
[1]Number of individuals in 1000 Genomes database found to have the allele;
[2]Number of unique human ethnic populations in 1000 Genomes database in which the allele was found to occur;
[3]Heterozygous human genotype frequency, ie, cumulative frequency of all genotypes having one occurrence of the variant allele and one occurrence of another allele (heterozygous state), eg, ac genotype in 1000 Genomes database;
[4]Homozygous human genotype frequency, ie, cumulative frequency of two occurrences of the variant allele (homozygous state), eg, cc genotype in 1000 Genomes database; and
[5]Total human genotype frequency, ie, total of heterozygous plus homozygous human genotype frequencies.
[6]Cumulative human allele frequency of all occurrences of the variant allele in 1000 Genomes database.
Form a' is identical to form a with the exception that form a' has a glycine (G) at position 620 (see US20120093818 (Amgen, Inc)); form a has E at this position.

(b) Nucleotide Sequence Variations of Selected Alleles

| Allele a | G | C | A | G | A | A | A |
|---|---|---|---|---|---|---|---|
| | | | Nucleotide Position[1] | | | | |
| | 1:55505647 | 1:55505668 | 1:55523802 | 1:55523855 | 1:55524237 | 1:55527222 | 1:55529187 |
| | | | Non-Synonymous Nucleotide Variation[2] | | | | |
| | T | T | G | A | G | C | G |
| | | | Variant ID[3] | | | | |
| Variant | rs11591147 | rs11583680 | rs28362261 | rs28362263 | rs562556 | rs28362277 | rs505151 |
| | | | Corresponding Amino Acid Variation | | | | |
| Allele | 46L | 53V | 425S | 443T | 474V | 619P | 670G |
| f | | | | | X | | |
| c | | | | | | | X |
| r | | | | | X | | X |
| p | | X | | | X | | |
| m | | | | X | | | |
| e | | | X | | X | | |
| h | | | | X | | X | |
| aj | X | | | | X | | |
| q | | X | | | | | X |

"x" in a box indicates that a variant allele comprises the non-synonymous nucleotide variation indicated in the 5th row.
Table Footnotes:
[1]Notation is chromosome number (all positions are on human chromosome 1): coordinate number (Ensembl release 73 - September 2013, Genome assembly: GRCh37 (GCA_000001405.13));
[2]Nucleotide change (compared to allele a nucleotide shown in first row) giving rise to an amino acid change in the variant form (compared to amino acid of allele a); and
[3]NCBI dbSNP reference number (NCBI dbSNP Build 138 released on Apr. 25, 2013).

TABLE 2

Sequences (a) Human PCSK9 Form a Amino Acid Sequence (SEQ ID NO: 1) - "Pro-form" with Signal Sequence

```
                                            46       53
MGTVSSRRSWWPLPLLLLLLLLLGPAGARA QEDEDGDYEELVLALRSEEDGLAEAPEHGTTATFHRCAKDP
WRLPGTYVVVLKEETHLSQSERTARRLQAQAARRGYLTKILHVFHGLLPGFLVKMSGDLLELALKLPH

VDYIEEDSSVFAQsipwnleritppryradeyqppdggslvevylldtsiqsdhreiegrvmvtdfenvpeedgtrfhrqaskcdshg
thlagvvsgrdagvakgasmrslrvlncqgkgtvsgtliglefirksqlvqpvgplvvllplaggysrvlnaacqrlaragvvlvtaagnfrddacly
spasapevitvgatnaqdqpvtlgtlgtnfgrcvdlfapgediigassdcstcfvsqsgtsqaaahvagiaammlsaepeltlaelrqrlihfsak
  425         443                                                    474
dvineawfpedqrvltpnlvaalppsthGAGWQLFCRTVWSAHSGPTRMATAIARCAPDEELLSCSSFSRSGKRRGERM
EAQGGKLVCRAHNAFGGEGVYAIARCCLLPQANCSVHTAPPAEASMGTRVHCHQQGHVLTGCSSHWEVEDLGT
                                                        619 620
HKPPVLRPRGQPNQCVGHREASIHASCCHAPGLECKVKEHGIPAPQEQVTVACEEGWTLTGCSALPGTSHVLGAY
             670
AVDNTCVVRSRDVSTTGSTSEEAVTAVAICCRSRHLAQASQELQ
```

*Italics* = signal sequence 1-30

TABLE 2-continued

Sequences

Courier = pro peptide 31-152 lower case = catalytic domain 153-449
UPPER CASE = C-terminal domain 450-692
Underlined = residues changed from allele a in other sequences (aa residue number shown)
The pro-form is the sequence from amino acid number 31 to (and including) amino acid number 692 of SEQ ID NO: 1.
The mature form is the sequence from amino acid number 153 to (and including) amino acid number 692 of SEQ ID NO: 1.

(b) Human PCSK9 Form a Amino Acid Sequence (SEQ ID NO: 3) - "Mature-form"
(Numbering and notation as per SEQ ID NO: 1 above has been retained)
sipwnleritppryradayqppdggslvevylldtsiqsdhreiegrvmvtdfenvpeedgtrfhrqaskcdshg
thlagvvsgrdagvakgasmrslrvlncqgkgtvsgtliglefirksqlvqpvgplvvllplaggysrvlnaacqrlaragvvlvtaagnfrddacly
spasapevitvgatnaqdqpvtlgtlgtnfgrcvdlfapgediigassdcstcfvsqsgtsqaaahvagiaammlsaepeltlaelrqrlihfsak
          425              443                      474
dvineawfpedqrvltpnlvaalppsthGAGWQLFCRTVWSAHSGPTRMATAIARCAPDEELLSCSSFSRSGKRRGERM
EAQGGKLVCRAHNAFGGEGVYAIARCCLLPQANCSVHTAPPAEASMGTRVHCHQQGHVLTGCSSHWEVEDLGT
                                                   619 620
HKPPVLRPRGQPNQCVGHREASIHASCCHAPGLECKVKEHGIPAPQEQVTVACEEGWTLTGCSALPGTSHVLGAY
            670
AVDNTCVVRSRDVSTTGSTSEEAVTAVAICCRSRHLAQASQELQ (c) Human PCSK9 Allele a Nucleotide Sequence (SEQ ID NO: 28) - Encoding "Pro-form" Plus Signal Sequence
*ATGGGCACCGTCAGCTCCAGGCGGTCCTGGTGGCCGCTGCCACTGCTGCTGCTGCTGCTGCTGCTCCTGGGTC*
                                                                          R46L CGT to CIT
*CCGCGGGCGCCCGTGCG*CAGGAGGACGAGGACGGCGACTACGAGGAGCTGGTGCTAGCCTTGCGTTCCG
           A53V GCC to GTC
AGGAGGACGGCCTGGCCGAAGCACCCGAGCACGGAACCACAGCCACCTTCCACCGCTGCGCCAAGGAT
CCGTGGAGGTTGCCTGGCACCTACGTGGTGGTGCTGAAGGAGGAGACCCACCTCTCGCAGTCAGAGCG
CACTGCCCGCCGCCTGCAGGCCCAGGCTGCCCGCCGGGGATACCTCACCAAGATCCTGCATGTCTTCC
ATGGCCTTCTTCCTGGCTTCCTGGTGAAGATGAGTGGCGACCTGCTGGAGCTGGCCTTGAAGTTGCCC
CATGTCGACTACATCGAGGAGGACTCCTCTGTCTTTGCCCAGagcatcccgtggaacctggagcggattacccctcca
cggtaccgggcggatgaataccagcccccgacggaggcagcctggtggaggtgtatctcctagacaccagcatacagagtgaccaccgggaa
atcgagggcagggtcatggtcaccgacttcgagaatgtgcccgaggaggacgggacccgcttccacagacaggccagcaagtgtgacagtcat
ggcacccacctggcagggtggtcagcggccgggatgccggcgtggccaaggtgccagcatgcgcagcctgcgcgtgctcaactgccaaggg
aagggcacggttagcggcaccctcataggcctggagtttattcggaaaagccagctggtccagcctgtggggccactggtggtgctgctgcccct
ggcgggtgggtacagccgcgtcctcaacgccgcctgccagcgcctggcgagggctggggtcgtgctggtcaccgctgccggcaacttccgggac
gatgcctgcctctactcccccagcctcagctcccgaggtcatcacagttggggccaccaatgcccaagaccagccggtgaccctggggactttggg
gaccaactttggccgctgtgtggacctctttgccccaggggaggacatcattggtgcctccagcgactgcagcacctgctttgtgtcacagagtgg
gacatcacaggctgctgcccacgtggctggcattgcagccatgatgctgtctgccgagccggagctcaccctggccgagttgaggcagagactg
              N425S AAT to AGT                               A443T GCC to ACC
atccacttctctgccaaagatgtcatcaatgaggcctggttccctgaggaccagcgggtactgaccccaacctggtggccgccctgccccccag
cacccatGGGGCAGGTTGGCAGCTGTTTTGCAGGACTGTATGGTCAGCACACTCGGGGCCTACACGGATGGCC
        I474V ATC to GTC
ACAGCCATCGCCCGCTGCGCCCCAGATGAGGAGCTGCTGAGCTGCTCCAGTTTCTCCAGGAGTGGGAAGCGG
CGGGGCGAGCGCATGGAGGCCCAAGGGGGCAAGCTGGTCTGCCGGGCCCACAACGCTTTTGGGGGTGAGG
GTGTCTACGCCATTGCCAGGTGCTGCCTGCTACCCCAGGCCAACTGCAGCGTCCACACAGCTCCACCAGCTGA
GGCCAGCATGGGGACCCGTGTCCACTGCCACCAACAGGGCCACGTCCTCACAGGCTGCAGCTCCCACTGGGA
GGTGGAGGACCTTGGCACCCACAAGCCGCCTGTGCTGAGGCCACGAGGTCAGCCCAACCAGTGCGTGGGCC
ACAGGGAGGCCAGCATCCACGCTTCCTGCTGCCATGCCCCAGGTCTGGAATGCAAAGTCAAGGAGCATGGAA
  Q619P CAG to CCG  E620G GAG to GGG
TCCCGGCCCCTCAGGAGCAGGTGACCGTGGCCTGCGAGGAGGGCTGGACCCTGACTGGCTGCAGTGCCCTCC
CTGGGACCTCCCACGTCCTGGGGGCCTACGCCGTAGACAACACGTGTGTAGTCAGGAGCCGGGACGTCAGCA
              E670G GAG to GGG
CTACAGGCAGCACCAGCGAAGAGGCCGTGACAGCCGTTGCCATCTGCTGCCGGAGCCGGCACCTGGCGCAG
GCCTCCCAGGAGCTCCAGTGAC

*Italics* = nucleotide sequence encoding signal sequence (nucleotides 1-90)
Courier = nucleotide sequence encoding pro peptide (nucleotides 91-456)

lower case = nucleotide sequence encoding catalytic domain (nucleotides 457-1346)
UPPER CASE = nucleotide sequence encoding C-terminal domain (nucleotides 1347-2076)
Underlined = allelic variations from allele a in other sequences (aa residue number changes and codon changes shown)
The pro-form is encoded by nucleotide sequence from nucleotide 91 to (and including) nucleotide 2076.
The mature form is encoded by nucleotide sequence from nucleotide 457 to (and including) nucleotide 2076.

Variant Allele Nucleotide Sequences

Thus, (i) The nucleotide sequence of allele f is identical to SEQ ID NO: 28 except that the nucleotide sequence of allele f comprises a GTC codon instead of an ATC codon at the position labelled "I474V" in SEQ ID NO: 28;

(ii) The nucleotide sequence of allele c is identical to SEQ ID NO: 28 except that the nucleotide sequence of allele c comprises a GGG codon instead of an GAG codon at the position labelled "E670G" in SEQ ID NO: 28;

(iii) The nucleotide sequence of allele r is identical to SEQ ID NO: 28 except that the nucleotide sequence of allele r comprises a GTC codon instead of an ATC codon at the position labelled "I474V" in SEQ ID NO: 28; and a GGG codon instead of an GAG codon at the position labelled "E670G" in SEQ ID NO: 28;

(iv) The nucleotide sequence of allele p is identical to SEQ ID NO: 28 except that the nucleotide sequence of allele p comprises a GTC codon instead of a GCC codon at the position labelled "A53V" in SEQ ID NO: 28; and a GTC codon instead of an ATC codon at the position labelled "I474V" in SEQ ID NO: 28;

(v) The nucleotide sequence of allele m is identical to SEQ ID NO: 28 except that the nucleotide sequence of allele m comprises a ACC codon instead of a GCC codon at the position labelled "A443T" in SEQ ID NO: 28;

(vi) The nucleotide sequence of allele e is identical to SEQ ID NO: 28 except that the nucleotide sequence of allele e comprises a AGT codon instead of an AAT codon at the position labelled "N425S" in SEQ ID NO: 28; and a GTC codon instead of an ATC codon at the position labelled "I474V" in SEQ ID NO: 28;

(vii) The nucleotide sequence of allele h is identical to SEQ ID NO: 28 except that the nucleotide sequence of allele h comprises a ACC codon instead of a GCC codon at the position labelled "A443T" in SEQ ID NO: 28; and a CCG codon instead of a CAG codon at the position labelled "Q619P" in SEQ ID NO: 28;

(viii) The nucleotide sequence of allele aj is identical to SEQ ID NO: 28 except that the nucleotide sequence of allele aj comprises a CTT codon instead of an CGT codon at the position labelled "R46L" in SEQ ID NO: 28; and a GTC codon instead of an ATC codon at the position labelled "I474V" in SEQ ID NO: 28; and (ix) The nucleotide sequence of allele q is identical to SEQ ID NO: 28 except that the nucleotide sequence of allele q comprises a GTC codon instead of a GCC codon at the position labelled "A53V" in SEQ ID NO: 28; and a GGG codon instead of an GAG codon at the position labelled "E670G" in SEQ ID NO: 28.

Variant Pro-Form Amino Acid Sequences (Numbering is as per SEQ ID NO: 1 recited above)

(A) The amino acid sequence of form f is identical to the amino acid sequence from amino acid number 31 to (and including) amino acid number 692 of SEQ ID NO: 1 except that the amino acid sequence of form f comprises a valine at position 474;

(B) The amino acid sequence of form c is identical to the amino acid sequence from amino acid number 31 to (and including) amino acid number 692 of SEQ ID NO: 1 except that the amino acid sequence of form c comprises a glycine at position 670;

(C) The amino acid sequence of form r is identical to the amino acid sequence from amino acid number 31 to (and including) amino acid number 692 of SEQ ID NO: 1 except that the amino acid sequence of form r comprises a valine at position 474 and a glycine at position 670;

(D) The amino acid sequence of form p is identical the amino acid sequence from amino acid number 31 to (and including) amino acid number 692 of SEQ ID NO: 1 except that the amino acid sequence of form p comprises a valine at position 53 and a valine at position 474;

(E) The amino acid sequence of form m is identical to the amino acid sequence from amino acid number 31 to (and including) amino acid number 692 of SEQ ID NO: 1 except that the amino acid sequence of form m comprises a threonine at position 443;

(F) The amino acid sequence of form e is identical to the amino acid sequence from amino acid number 31 to (and including) amino acid number 692 of SEQ ID NO: 1 except that the amino acid sequence of form e comprises a serine at position 425 and a valine at position 474;

(G) The amino acid sequence of form h is identical to the amino acid sequence from amino acid number 31 to (and including) amino acid number 692 of SEQ ID NO: 1 except that the amino acid sequence of form h comprises a threonine at position 443 and a proline at position 619;

(H) The amino acid sequence of form aj is identical to the amino acid sequence from amino acid number 31 to (and including) amino acid number 692 of SEQ ID NO: 1 except that the amino acid sequence of form aj comprises a leucine at position 46 and a valine at position 474; and (I) The amino acid sequence of form q is identical to the amino acid sequence from amino acid number 31 to (and including) amino acid number 692 of SEQ ID NO: 1 except that the amino acid sequence of form q comprises a valine at position 53 and a glycine at position 670.

Variant Mature Form Amino Acid Sequences (Numbering is as per SEQ ID NO: 1 recited above)

(A') The amino acid sequence of form f is identical to SEQ ID NO: 2 except that the amino acid sequence of form f comprises a valine at position 474;

(B') The amino acid sequence of form c is identical to SEQ ID NO: 2 except that the amino acid sequence of form c comprises a glycine at position 670;

(C') The amino acid sequence of form r is identical to SEQ ID NO: 2 except that the amino acid sequence of form r comprises a valine at position 474 and a glycine at position 670;

(D') The amino acid sequence of form p is identical to SEQ ID NO: 2 except that the amino acid sequence of form p comprises a valine at position 474;

(E') The amino acid sequence of form m is identical to SEQ ID NO: 2 except that the amino acid sequence of form m comprises a threonine at position 443;

(F') The amino acid sequence of form e is identical to SEQ ID NO: 2 except that the amino acid sequence of form e comprises a serine at position 425 and a valine at position 474;

(G') The amino acid sequence of form h is identical to SEQ ID NO: 2 except that the amino acid sequence of form h comprises a threonine at position 443 and a proline at position 619;

(H') The amino acid sequence of form aj is identical to SEQ ID NO: 2 except that the amino acid sequence of form aj comprises valine at position 474; and (I') The amino acid sequence of form q is identical to SEQ ID NO: 2 except that the amino acid sequence of form q comprises a glycine at position 670.

The mature form of p is identical to the mature form off and aj.

The mature form of c is identical to the mature form of q.

Further sequence analysis and 3D in silico modelling (see FIG. 1) revealed that selected variants also fulfilled the following selection criteria:—

PCSK9 variants whose variant amino acid residues (versus the common form of human PCSK9) are found in the mature form of the target (ie, outside the pro-domain); and PCSK9 variants whose variant amino acid residues (versus the common form of human PCSK9) are surface-exposed on the target, which the inventor saw as contributing to determining the topography of the target and potentially contributing to how and where ligand binding on the target occurs.

As shown in FIG. 1, identified positions 425, 443, 474, 619 and 670 (found in the selected variants of the invention) are all surface-exposed and outside of the pro-domain. Variant positions 425 and 443 are surface-exposed on the catalytic domain, while variant positions 474, 619 and 670 are surface-exposed on the C-terminal domain.

In a first example, the invention addresses the need to treat humans having naturally-occurring rarer natural PCSK9 alleles, genotypes and phenotypes (rarer protein forms). In this respect, the invention provides the following aspects:

In a First Aspect: An anti-human PCSK9 ligand for use in a method of treating and/or preventing a PCSK9-mediated disease or condition in a human whose genome comprises a nucleotide sequence selected from the group consisting of SEQ ID NOs: 29-37, wherein the method comprises administering the ligand to the human.

In an example, the nucleotide sequence is selected from the group consisting of SEQ ID NOs: 29-35 and 37; or selected from the group consisting of SEQ ID NOs: 29-32 and 34-37; or selected from the group consisting of SEQ ID NOs: 29-32, 34, 35 and 37. These are naturally-occurring allele (haplotype) sequences that do not encode 46L and which meet the criteria set out above. These groups comprise variants that are associated with elevated LDL-C.

In an example, the nucleotide sequence is SEQ ID NO: 34, that encodes a 425S, which is associated with elevated LDL-C (Pisciotta et al 2006).

In an example, the nucleotide sequence selected from the group consisting of SEQ ID NOs: 31 and 37, that encode 670G which is a marker for severity of coronary atherosclerosis (Chen et al 2005).

In an example, the nucleotide sequence selected from the group consisting of SEQ ID NOs: 31, 32, 34, 35, 36 and 37; or selected from the group consisting of SEQ ID NOs: 31, 32, 34, 35 and 37. These are allele (haplotype) sequences that have a naturally-occurring combination of differences from SEQ ID NO: 28 (form a) and which meet the criteria set out above.

In an example, the nucleotide sequence is SEQ ID NO: 29.
In an example, the nucleotide sequence is SEQ ID NO: 30.
In an example, the nucleotide sequence is SEQ ID NO: 31.
In an example, the nucleotide sequence is SEQ ID NO: 32.
In an example, the nucleotide sequence is SEQ ID NO: 33.
In an example, the nucleotide sequence is SEQ ID NO: 34.
In an example, the nucleotide sequence is SEQ ID NO: 35.
In an example, the nucleotide sequence is SEQ ID NO: 36.
In an example, the nucleotide sequence is SEQ ID NO: 37.

In the alternative the nucleotide sequence encodes a human PCSK9 comprising a mutation R46L, A53V, N425S, A443T, I474V, Q619P and E670G (eg, comprises a mutation I474, E670G, N425S or Q619P) in SEQ ID NO: 1; for example, the PCSK9 comprises I474V in SEQ ID NO: 1 and optionally the human comprises such a PCSK9 or a nucleotide sequence encoding such a PCSK9 (eg, wherein the method is for treating or preventing dislipidemia, eg reducing cholesterol or maintaining reduced cholesterol in the human); for example, the PCSK9 comprises E670G in SEQ ID NO: 1 and optionally the human comprises such a PCSK9 or a nucleotide sequence encoding such a PCSK9 (eg, wherein the method is for treating or preventing dislipidemia, eg reducing cholesterol or maintaining reduced cholesterol in the human); for example, the PCSK9 comprises Q619P in SEQ ID NO: 1 and optionally the human comprises such a PCSK9 or a nucleotide sequence encoding such a PCSK9 (eg, wherein the method is for treating or preventing dislipidemia, eg reducing cholesterol or maintaining reduced cholesterol in the human); for example, the PCSK9 comprises N425S in SEQ ID NO: 1 and optionally the human comprises such a PCSK9 or a nucleotide sequence encoding such a PCSK9 (eg, wherein the method is for treating or preventing dislipidemia, eg reducing cholesterol or maintaining reduced cholesterol in the human); for example, the PCSK9 comprises R46L in SEQ ID NO: 1 and optionally the human comprises such a PCSK9 or a nucleotide sequence encoding such a PCSK9 (eg, wherein the method is for treating or preventing dislipidemia, eg increasing cholesterol in the human); for example, the PCSK9 comprises A53V in SEQ ID NO: 1 and optionally the human comprises such a PCSK9 or a nucleotide sequence encoding such a PCSK9 (eg, wherein the method is for treating or preventing dislipidemia, eg increasing cholesterol in the human); for example, the PCSK9 comprises A443T in SEQ ID NO: 1 and optionally the human comprises such a PCSK9 or a nucleotide sequence encoding such a PCSK9 (eg, wherein the method is for treating or preventing dislipidemia, eg increasing cholesterol in the human).

In a Second Aspect: The ligand of aspect 1, wherein the ligand has been or is determined as capable of binding a human PCSK9 selected from the group consisting forms f, c, r, p, m, e, h, aj and q.

In the alternative the ligand has been or is determined as capable of binding a human PCSK9 comprising a mutation R46L, A53V, N425S, A443T, I474V, Q619P and E670G (eg, comprises a mutation I474, E670G, N425S or Q619P) in SEQ ID NO: 1; for example, the PCSK9 comprises I474V in SEQ ID NO: 1 and optionally the human comprises such a PCSK9 or a nucleotide sequence encoding such a PCSK9 (eg, wherein the method is for treating or preventing dislipidemia, eg reducing cholesterol or maintaining reduced cholesterol in the human); for example, the PCSK9 comprises E670G in SEQ ID NO: 1 and optionally the human comprises such a PCSK9 or a nucleotide sequence encoding such a PCSK9 (eg, wherein the method is for treating or preventing dislipidemia, eg reducing cholesterol or maintaining reduced cholesterol in the human); for example, the PCSK9 comprises Q619P in SEQ ID NO: 1 and optionally the human comprises such a PCSK9 or a nucleotide sequence encoding such a PCSK9 (eg, wherein the method is for treating or preventing dislipidemia, eg reducing cholesterol or maintaining reduced cholesterol in the human); for example, the PCSK9 comprises N425S in SEQ ID NO: 1 and optionally the human comprises such a PCSK9 or a nucleotide sequence encoding such a PCSK9 (eg, wherein the method is for treating or preventing dislipidemia, eg reducing cholesterol or maintaining reduced cholesterol in the human); for example, the PCSK9 comprises R46L in SEQ ID NO: 1 and optionally the human comprises such a PCSK9 or a nucleotide sequence encoding such a PCSK9 (eg, wherein the method is for treating or preventing dislipidemia, eg increasing cholesterol in the human); for example, the PCSK9 comprises A53V in SEQ ID NO: 1 and optionally the human comprises such a PCSK9 or a nucleotide sequence encoding such a PCSK9 (eg, wherein the method is for treating or preventing dislipidemia, eg increasing cholesterol in the human); for example, the PCSK9 comprises A443T in SEQ ID NO: 1 and optionally the human comprises such a PCSK9 or a nucleotide sequence encoding such a PCSK9 (eg, wherein the method is for treating or preventing dislipidemia, eg increasing cholesterol in the human).

In an example of any aspect, the ligand binds (or has been determined to bind) two, three, four or more human PCSK9 selected from the group consisting forms f, c, r, p, m, e, h, aj and q or said PCSK9s in said alternative.

In an example of any aspect, the ligand comprises a protein domain that specifically binds to PCSK9, eg, a human PCSK9 selected from the group consisting forms f, c, r, p, m, e, h, aj and q, or said PCSK9s in said alternative.

The term "specifically binds," or the like, means that a ligand, eg, an antibody or antigen-binding fragment thereof, forms a complex with an antigen that is relatively stable under physiologic conditions. Specific binding can be characterized by an equilibrium dissociation constant of at least about $1 \times 10^{-6}$M or less (e.g., a smaller KD denotes a tighter binding). Methods for determining whether two molecules specifically bind are well known in the art and include, for example, equilibrium dialysis, surface plasmon resonance, and the like. An isolated antibody that specifically binds a human PCSK9 may, however, exhibit cross-reactivity to other antigens such as a PCSK9 molecule from another species. Moreover, multi-specific antibodies (e.g., bispecifics) that bind to human PCSK9 and one or more additional antigens are nonetheless considered antibodies that "specifically bind" PCSK9, as used herein.

In an example of any aspect, the ligand comprises or consists of a protein that mimics the EGFA domain of the LDL receptor and specifically binds to PCSK9, eg, a human PCSK9 selected from the group consisting forms f, c, r, p, m, e, h, aj and q, or said PCSK9s in said alternative.

In an example of any aspect, the ligand antagonises PCSK9, eg, a human PCSK9 selected from the group consisting forms f, c, r, p, m, e, h, aj and q, or said PCSK9s in said alternative.

In an example of any aspect, the method comprises (before administering the ligand) the step of determining that the ligand is capable of binding a human PCSK9 selected from the group consisting forms f, c, r, p, m, e, h, aj and q, or said PCSK9s in said alternative.

In an example of any aspect, binding is determined by SPR. In an example of any aspect, binding is determined by ELISA.

In an example of any aspect, said forms are the mature forms.

In an example of any aspect, said forms are the pro-forms.

In a Third Aspect: A ligand that binds (i) a PCSK9 of said alternative or (ii) a human PCSK9 comprising an amino acid sequence selected from the group consisting of SEQ ID NOs: 4-27 for use in a method comprising the step of using the ligand to target said PCSK9 in a human to treat and/or prevent a disease or condition mediated by PCSK9, the method comprising administering the ligand to the human.

In an example, the disease or condition is mediated by (i) a PCSK9 of said alternative or (ii) a human PCSK9 comprising an amino acid sequence selected from the group consisting of SEQ ID NOs: 4-27.

In an example, the amino acid sequence selected from the group consisting of SEQ ID NOs: 4-23, 26 and 27; or selected from the group consisting of SEQ ID NOs: 4-14 and 18-27; or selected from the group consisting of SEQ ID NOs: 4-14, 18-23, 26 and 27. These are naturally-occurring sequences that do not comprise 46L and which meet the criteria set out above. These groups comprise variants that are associated with elevated LDL-C.

In an example, the amino acid sequence is SEQ ID NO: 18, 19 or 20, that comprises a 425S, which is associated with elevated LDL-C (Pisciotta et al 2006).

In an example, the amino acid sequence selected from the group consisting of SEQ ID NOs: 10, 11, 12, 26 and 27, that comprise 670G which is a marker for severity of coronary atherosclerosis (Chen et al 2005).

In an example, the amino acid sequence selected from the group consisting of SEQ ID NOs: 10-14 and 18-27; or selected from the group consisting of SEQ ID NOs: 10-14, 18-23, 26 and 27. These are sequences that have a naturally-occurring combination of differences from SEQ ID NOs: 1-3 (form a) and which meet the criteria set out above.

In an example, the amino acid sequence is SEQ ID NO: 4.
In an example, the amino acid sequence is SEQ ID NO: 5.
In an example, the amino acid sequence is SEQ ID NO: 6.
In an example, the amino acid sequence is SEQ ID NO: 7.
In an example, the amino acid sequence is SEQ ID NO: 8.
In an example, the amino acid sequence is SEQ ID NO: 9.
In an example, the amino acid sequence is SEQ ID NO: 10.
In an example, the amino acid sequence is SEQ ID NO: 11.
In an example, the amino acid sequence is SEQ ID NO: 12.
In an example, the amino acid sequence is SEQ ID NO: 13.
In an example, the amino acid sequence is SEQ ID NO: 14.
In an example, the amino acid sequence is SEQ ID NO: 15.
In an example, the amino acid sequence is SEQ ID NO: 16.
In an example, the amino acid sequence is SEQ ID NO: 17.
In an example, the amino acid sequence is SEQ ID NO: 18.
In an example, the amino acid sequence is SEQ ID NO: 19.
In an example, the amino acid sequence is SEQ ID NO: 20.
In an example, the amino acid sequence is SEQ ID NO: 21.
In an example, the amino acid sequence is SEQ ID NO: 22.
In an example, the amino acid sequence is SEQ ID NO: 23.
In an example, the amino acid sequence is SEQ ID NO: 24.
In an example, the amino acid sequence is SEQ ID NO: 25.
In an example, the amino acid sequence is SEQ ID NO: 26.
In an example, the amino acid sequence is SEQ ID NO: 27.

In a Fourth Aspect: The ligand of aspect 3, wherein the genome of the human comprises a nucleotide sequence selected from the group consisting of SEQ ID NOs: 29-37; or a nucleotide sequence encoding a PCSK9 of said alternative.

In an example, the nucleotide sequence is selected from the group consisting of SEQ ID NOs: 29-35 and 37; or selected from the group consisting of SEQ ID NOs: 29-32 and 34-37; or selected from the group consisting of SEQ ID NOs: 29-32, 34, 35 and 37. These are naturally-occurring allele (haplotype) sequences that do not encode 46L and which meet the criteria set out above. These groups comprise variants that are associated with elevated LDL-C.

In an example, the nucleotide sequence is SEQ ID NO: 34, that encodes a 425S, which is associated with elevated LDL-C (Pisciotta et al 2006).

In an example, the nucleotide sequence selected from the group consisting of SEQ ID NOs: 31 and 37, that encode 670G which is a marker for severity of coronary atherosclerosis (Chen et al 2005).

In an example, the nucleotide sequence selected from the group consisting of SEQ ID NOs: 31, 32, 34, 35, 36 and 37; or selected from the group consisting of SEQ ID NOs: 31, 32, 34, 35 and 37. These are allele (haplotype) sequences that have a naturally-occurring combination of differences from SEQ ID NO: 28 (form a) and which meet the criteria set out above.

In an example, the nucleotide sequence is SEQ ID NO: 29.
In an example, the nucleotide sequence is SEQ ID NO: 30.
In an example, the nucleotide sequence is SEQ ID NO: 31.
In an example, the nucleotide sequence is SEQ ID NO: 32.

In an example, the nucleotide sequence is SEQ ID NO: 33
In an example, the nucleotide sequence is SEQ ID NO: 34
In an example, the nucleotide sequence is SEQ ID NO: 35.
In an example, the nucleotide sequence is SEQ ID NO: 36.
In an example, the nucleotide sequence is SEQ ID NO: 37.

In a Fifth Aspect: The ligand of any preceding aspect, wherein the human has been or is genotyped as positive for a nucleotide sequence selected from the group consisting of SEQ ID NOs: 29-37 or at least the catalytic domain- or C-terminal domain-encoding sequence thereof.

In an example, the nucleotide sequence is selected from the group consisting of SEQ ID NOs: 29-35 and 37; or selected from the group consisting of SEQ ID NOs: 29-32 and 34-37; or selected from the group consisting of SEQ ID NOs: 29-32, 34, 35 and 37. These are naturally-occurring allele (haplotype) sequences that do not encode 46L and which meet the criteria set out above. These groups comprise variants that are associated with elevated LDL-C.

In an example, the nucleotide sequence is SEQ ID NO: 34, that encodes a 425S, which is associated with elevated LDL-C (Pisciotta et al 2006).

In an example, the nucleotide sequence selected from the group consisting of SEQ ID NOs: 31 and 37, that encode 670G which is a marker for severity of coronary atherosclerosis (Chen et al 2005).

In an example, the nucleotide sequence selected from the group consisting of SEQ ID NOs: 31, 32, 34, 35, 36 and 37; or selected from the group consisting of SEQ ID NOs: 31, 32, 34, 35 and 37. These are allele (haplotype) sequences that have a naturally-occurring combination of differences from SEQ ID NO: 28 (form a) and which meet the criteria set out above.

In an example, the nucleotide sequence is SEQ ID NO: 29.
In an example, the nucleotide sequence is SEQ ID NO: 30.
In an example, the nucleotide sequence is SEQ ID NO: 31.
In an example, the nucleotide sequence is SEQ ID NO: 32.
In an example, the nucleotide sequence is SEQ ID NO: 33.
In an example, the nucleotide sequence is SEQ ID NO: 34.
In an example, the nucleotide sequence is SEQ ID NO: 35.
In an example, the nucleotide sequence is SEQ ID NO: 36.
In an example, the nucleotide sequence is SEQ ID NO: 37.

In a Sixth Aspect: The ligand of any preceding aspect, wherein the human has been or is phenotyped as positive for (i) a PCSK9 of said alternative or (ii) a human PCSK9 selected from the group consisting of forms f, c, r, p, m, e, h, aj and q or at least the catalytic or C-terminal domain thereof.

In an example, said forms are the mature forms.
In an example, said forms are the pro-forms.

In a Seventh Aspect: The ligand of any preceding aspect, wherein the method comprises genotyping the human as positive for a nucleotide sequence selected from the group consisting of SEQ ID NOs: 29-37 or at least the catalytic domain- or C-terminal domain-encoding sequence thereof; or a nucleotide sequence encoding a PCSK9 of said alternative.

In an example, the nucleotide sequence is selected from the group consisting of SEQ ID NOs: 29-35 and 37; or selected from the group consisting of SEQ ID NOs: 29-32 and 34-37; or selected from the group consisting of SEQ ID NOs: 29-32, 34, 35 and 37. These are naturally-occurring allele (haplotype) sequences that do not encode 46L and which meet the criteria set out above. These groups comprise variants that are associated with elevated LDL-C.

In an example, the nucleotide sequence is SEQ ID NO: 34, that encodes a 425S, which is associated with elevated LDL-C (Pisciotta et al 2006).

In an example, the nucleotide sequence selected from the group consisting of SEQ ID NOs: 31 and 37, that encode 670G which is a marker for severity of coronary atherosclerosis (Chen et al 2005).

In an example, the nucleotide sequence selected from the group consisting of SEQ ID NOs: 31, 32, 34, 35, 36 and 37; or selected from the group consisting of SEQ ID NOs: 31, 32, 34, 35 and 37. These are allele (haplotype) sequences that have a naturally-occurring combination of differences from SEQ ID NO: 28 (form a) and which meet the criteria set out above.

In an example, the nucleotide sequence is SEQ ID NO: 29.
In an example, the nucleotide sequence is SEQ ID NO: 30.
In an example, the nucleotide sequence is SEQ ID NO: 31.
In an example, the nucleotide sequence is SEQ ID NO: 32.
In an example, the nucleotide sequence is SEQ ID NO: 33.
In an example, the nucleotide sequence is SEQ ID NO: 34.
In an example, the nucleotide sequence is SEQ ID NO: 35.
In an example, the nucleotide sequence is SEQ ID NO: 36.
In an example, the nucleotide sequence is SEQ ID NO: 37.

In an Eighth Aspect: The ligand of any preceding aspect, wherein the method comprises phenotyping the human has positive for (i) a PCSK9 of said alternative or (ii) a human PCSK9 selected from the group consisting of forms f, c, r, p, m, e, h, aj and q or at least the catalytic or C-terminal domain thereof.

In an example, said forms are the mature forms.
In an example, said forms are the pro-forms.

In a Ninth Aspect: The ligand of any preceding aspect, wherein the human has been or is genotyped as heterozygous for a nucleotide sequence selected from the group consisting of SEQ ID NOs: 29-37 or at least the catalytic domain- or C-terminal domain-encoding sequence thereof; or a nucleotide sequence encoding a PCSK9 of said alternative; optionally wherein the human has been or is genotyped as comprising the nucleotide sequence of SEQ ID NO: 28 or at least the catalytic domain- or C-terminal domain-encoding sequence thereof and a nucleotide sequence selected from the group consisting of SEQ ID NOs: 29-37 or at least the catalytic domain- or C-terminal domain-encoding sequence thereof; or a nucleotide sequence encoding a PCSK9 of said alternative.

"Heterozygous" here means that in the human's genotype one allele comprises a nucleotide sequence selected from the group consisting of SEQ ID NOs: 29-37 or at least the catalytic domain- or C-terminal domain-encoding sequence thereof and other allele can be any PCSK9 (eg, form a, a' or an allele comprising a nucleotide sequence selected from the group consisting of SEQ ID NOs: 29-37 or at least the catalytic domain- or C-terminal domain-encoding sequence thereof).

In an example, the method comprises (before administering the ligand) genotyping the human as heterozygous for a nucleotide sequence selected from the group consisting of SEQ ID NOs: 29-37 or at least the catalytic domain- or C-terminal domain-encoding sequence thereof; optionally also genotyping the human as comprising the nucleotide sequence of SEQ ID NO: 28 or at least the catalytic domain- or C-terminal domain-encoding sequence thereof and a nucleotide sequence selected from the group consisting of SEQ ID NOs: 29-37 or at least the catalytic domain- or C-terminal domain-encoding sequence thereof.

In an example, the nucleotide sequence is selected from the group consisting of SEQ ID NOs: 29-35 and 37; or selected from the group consisting of SEQ ID NOs: 29-32 and 34-37; or selected from the group consisting of SEQ ID NOs: 29-32, 34, 35 and 37.

These are naturally-occurring allele (haplotype) sequences that do not encode 46L and which meet the criteria set out above. These groups comprise variants that are associated with elevated LDL-C.

In an example, the nucleotide sequence is SEQ ID NO: 34, that encodes a 425S, which is associated with elevated LDL-C (Pisciotta et al 2006).

In an example, the nucleotide sequence selected from the group consisting of SEQ ID NOs: 31 and 37, that encode 670G which is a marker for severity of coronary atherosclerosis (Chen et al 2005).

In an example, the nucleotide sequence selected from the group consisting of SEQ ID NOs: 31, 32, 34, 35, 36 and 37; or selected from the group consisting of SEQ ID NOs: 31, 32, 34, 35 and 37. These are allele (haplotype) sequences that have a naturally-occurring combination of differences from SEQ ID NO: 28 (form a) and which meet the criteria set out above.

In an example, the nucleotide sequence is SEQ ID NO: 29.
In an example, the nucleotide sequence is SEQ ID NO: 30.
In an example, the nucleotide sequence is SEQ ID NO: 31.
In an example, the nucleotide sequence is SEQ ID NO: 32.
In an example, the nucleotide sequence is SEQ ID NO: 33.
In an example, the nucleotide sequence is SEQ ID NO: 34.
In an example, the nucleotide sequence is SEQ ID NO: 35.
In an example, the nucleotide sequence is SEQ ID NO: 36.
In an example, the nucleotide sequence is SEQ ID NO: 37.

In a Tenth Aspect: The ligand of any one of aspects 1 to 9, wherein the genome of the human has been or is genotyped as homozygous for a nucleotide sequence selected from the group consisting of SEQ ID NOs: 29-37 or at least the catalytic domain- or C-terminal domain-encoding sequence thereof; or a nucleotide sequence encoding a PCSK9 of said alternative.

"Homozygous" here means that in the human's genotype each allele comprises the same nucleotide sequence selected from the group consisting of SEQ ID NOs: 29-37 or at least the catalytic domain- or C-terminal domain-encoding sequence thereof.

In an example, the method comprises genotyping the human as homozygous for a nucleotide sequence selected from the group consisting of SEQ ID NOs: 29-37 or at least the catalytic domain- or C-terminal domain-encoding sequence thereof; or a nucleotide sequence encoding a PCSK9 of said alternative.

In an example, the nucleotide sequence is selected from the group consisting of SEQ ID NOs: 29-35 and 37; or selected from the group consisting of SEQ ID NOs: 29-32 and 34-37; or selected from the group consisting of SEQ ID NOs: 29-32, 34, 35 and 37. These are naturally-occurring allele (haplotype) sequences that do not encode 46L and which meet the criteria set out above. These groups comprise variants that are associated with elevated LDL-C.

In an example, the nucleotide sequence is SEQ ID NO: 34, that encodes a 425S, which is associated with elevated LDL-C (Pisciotta et al 2006).

In an example, the nucleotide sequence selected from the group consisting of SEQ ID NOs: 31 and 37, that encode 670G which is a marker for severity of coronary atherosclerosis (Chen et al 2005).

In an example, the nucleotide sequence selected from the group consisting of SEQ ID NOs: 31, 32, 34, 35, 36 and 37; or selected from the group consisting of SEQ ID NOs: 31, 32, 34, 35 and 37. These are allele (haplotype) sequences that have a naturally-occurring combination of differences from SEQ ID NO: 28 (form a) and which meet the criteria set out above.

In an example, the nucleotide sequence is SEQ ID NO: 29.
In an example, the nucleotide sequence is SEQ ID NO: 30.
In an example, the nucleotide sequence is SEQ ID NO: 31.
In an example, the nucleotide sequence is SEQ ID NO: 32.
In an example, the nucleotide sequence is SEQ ID NO: 33.
In an example, the nucleotide sequence is SEQ ID NO: 34.
In an example, the nucleotide sequence is SEQ ID NO: 35.
In an example, the nucleotide sequence is SEQ ID NO: 36.
In an example, the nucleotide sequence is SEQ ID NO: 37.

In an Eleventh Aspect: The ligand of any preceding aspect, wherein the ligand comprises an antibody binding site that binds (i) a PCSK9 of said alternative or (ii) a human PCSK9 comprising an amino acid sequence selected from the group consisting of SEQ ID NOs: 4-27 and optionally has been or is determined as capable of such binding.

In an example, the method comprises (before administering the ligand) the step of determining that the ligand is capable of binding to said human PCSK9.

In an example, the binding is specific binding. In an example, the ligand binds (or has been determined as binding) to the PCSK9 with an affinity (Kd) of 1 mM, 100 nM, 10 nM or 1 nM or less. In an embodiment, the affinity is no less than 10, 100 or 1000 fM.

In an example, binding or affinity is determined by SPR or ELISA.

In an example, the disease or condition is mediated by a human PCSK9 comprising an amino acid sequence selected from the group consisting of SEQ ID NOs: 4-27.

In an example, the amino acid sequence selected from the group consisting of SEQ ID NOs: 4-23, 26 and 27; or selected from the group consisting of SEQ ID NOs: 4-14 and 18-27; or selected from the group consisting of SEQ ID NOs: 4-14, 18-23, 26 and 27. These are naturally-occurring sequences that do not comprise 46L and which meet the criteria set out above. These groups comprise variants that are associated with elevated LDL-C.

In an example, the amino acid sequence is SEQ ID NO: 18, 19 or 20, that comprises a 425S, which is associated with elevated LDL-C (Pisciotta et al 2006).

In an example, the amino acid sequence selected from the group consisting of SEQ ID NOs: 10, 11, 12, 26 and 27, that comprise 670G which is a marker for severity of coronary atherosclerosis (Chen et al 2005).

In an example, the amino acid sequence selected from the group consisting of SEQ ID NOs: 10-14 and 18-27; or selected from the group consisting of SEQ ID NOs: 10-14, 18-23, 26 and 27. These are sequences that have a naturally-occurring combination of differences from SEQ ID NOs: 1-3 (form a) and which meet the criteria set out above In an example, the amino acid sequence is SEQ ID NO: 4.
In an example, the amino acid sequence is SEQ ID NO: 5.
In an example, the amino acid sequence is SEQ ID NO: 6.
In an example, the amino acid sequence is SEQ ID NO: 7.
In an example, the amino acid sequence is SEQ ID NO: 8.
In an example, the amino acid sequence is SEQ ID NO: 9.
In an example, the amino acid sequence is SEQ ID NO: 10.
In an example, the amino acid sequence is SEQ ID NO: 11.
In an example, the amino acid sequence is SEQ ID NO: 12.
In an example, the amino acid sequence is SEQ ID NO: 13.
In an example, the amino acid sequence is SEQ ID NO: 14.
In an example, the amino acid sequence is SEQ ID NO: 15.
In an example, the amino acid sequence is SEQ ID NO: 16.
In an example, the amino acid sequence is SEQ ID NO: 17.
In an example, the amino acid sequence is SEQ ID NO: 18.
In an example, the amino acid sequence is SEQ ID NO: 19.
In an example, the amino acid sequence is SEQ ID NO: 20.
In an example, the amino acid sequence is SEQ ID NO: 21.

In an example, the amino acid sequence is SEQ ID NO: 22.
In an example, the amino acid sequence is SEQ ID NO: 23.
In an example, the amino acid sequence is SEQ ID NO: 24.
In an example, the amino acid sequence is SEQ ID NO: 25.
In an example, the amino acid sequence is SEQ ID NO: 26.
In an example, the amino acid sequence is SEQ ID NO: 27.

In a Twelfth Aspect: The ligand of aspect 11, wherein the ligand is an antibody or antibody fragment. For example, the antibody or antibody fragment is a PCSK9 antagonist, eg, neutralises PCSK9.

Examples of such antibodies are disclosed, for instance, in WO 2008/057457, WO2008/057458, WO 2008/057459, WO 2008/063382, WO 2008/133647, WO 2009/100297, WO 2009/100318, WO 2011/037791, WO 2011/053759, WO 2011/053783, WO 2008/125623, WO 2011/072263, WO 2009/055783, WO 2010/029513, WO 2011/111007, WO 2010/077854, the disclosures and sequences of such antibodies being incorporated herein for use in the invention in their entireties by reference. One specific example is AMG 145 (Amgen), LY3015014 (Eli Lilly) or alirocumab. Advantageously, the ligand is or comprises alirocumab. Alternatively, the ligand is or comprises evolocumab.

In an example, the ligand is SAR236553/REGN727 (Sanofi Aventis/Regeneron) or a PCSK9-binding derivative thereof.

In an example, the ligand comprises or consists of a neutralizing antibody that binds to the PCSK9, wherein the antibody binds to PCSK9 and reduces the likelihood that PCSK9 binds to LDLR.

The ligand of aspect 11, wherein the ligand is a PCSK9 antagonist, eg, neutralises PCSK9.

In an example of any aspect of the invention, the ligand comprises or consists a ligand selected from evolocumab, 1D05-IgG2 (Merck & Co.), ALN-PCS02 (Alnylam), RN316 (Pfizer-Rinat), LY3015014 (Eli Lilly) and alirocumab (SAR236553/REGN727; Sanofi Aventis/Regeneron).

In Thirteenth Aspect: The ligand of any one of aspects 1 to 10, wherein (i) the ligand comprises a sequence of contiguous nucleotides that specifically hybridises to a nucleotide sequence selected from the group consisting of SEQ ID NOs: 29-37 or at least the catalytic domain- or C-terminal domain-encoding sequence thereof (or hybridizes to a nucleotide sequence encoding a PCSK9 of said alternative), or specifically hybridises to an antisense sequence or an RNA transcript of said sequence, wherein said sequence of contiguous nucleotides hybridises to at least one nucleotide present in said selected sequence which is not present in SEQ ID NO: 28 or hybridises to an antisense sequence or an RNA transcript thereof respectively; and/or (ii) the ligand comprises a sequence of at least 10 contiguous nucleotides of a nucleotide sequence selected from the group consisting of SEQ ID NOs: 29-37 thereof (or a nucleotide sequence encoding a PCSK9 of said alternative) or is an antisense sequence or RNA version of said contiguous nucleotides, wherein said sequence of contiguous nucleotides comprises at least one nucleotide present in said selected sequence which is not present in SEQ ID NO: 28.

In an example, the nucleotide sequence is selected from the group consisting of SEQ ID NOs: 29-35 and 37; or selected from the group consisting of SEQ ID NOs: 29-32 and 34-37; or selected from the group consisting of SEQ ID NOs: 29-32, 34, 35 and 37. These are naturally-occurring allele (haplotype) sequences that do not encode 46L and which meet the criteria set out above. These groups comprise variants that are associated with elevated LDL-C.

In an example, the nucleotide sequence is SEQ ID NO: 34, that encodes a 425S, which is associated with elevated LDL-C (Pisciotta et al 2006).

In an example, the nucleotide sequence selected from the group consisting of SEQ ID NOs: 31 and 37, that encode 670G which is a marker for severity of coronary atherosclerosis (Chen et al 2005).

In an example, the nucleotide sequence selected from the group consisting of SEQ ID NOs: 31, 32, 34, 35, 36 and 37; or selected from the group consisting of SEQ ID NOs: 31, 32, 34, 35 and 37. These are allele (haplotype) sequences that have a naturally-occurring combination of differences from SEQ ID NO: 28 (form a) and which meet the criteria set out above.

In an example, the nucleotide sequence is SEQ ID NO: 29.
In an example, the nucleotide sequence is SEQ ID NO: 30.
In an example, the nucleotide sequence is SEQ ID NO: 31.
In an example, the nucleotide sequence is SEQ ID NO: 32.
In an example, the nucleotide sequence is SEQ ID NO: 33.
In an example, the nucleotide sequence is SEQ ID NO: 34.
In an example, the nucleotide sequence is SEQ ID NO: 35.
In an example, the nucleotide sequence is SEQ ID NO: 36.
In an example, the nucleotide sequence is SEQ ID NO: 37.

In an embodiment, the ligand comprises at least 10, 11, 12, 13, 14, 15, 20, 25, 30, 35, 40, 45, 50 or 100 contiguous nucleotides of said nucleotide sequence.

In a Fourteenth Aspect: The ligand of any preceding aspect, wherein said disease or condition is hyperlipidaemia, hypercholesterolaemia (eg, familial hypercholesterolaemia), heart attack, stroke, coronary heart disease, atherosclerosis or a cardiovascular disease or condition.

The ligand of any preceding aspect, wherein the disease or condition is hypercholesterolemia, hyperlipidemia, hypercholesterolemia, dyslipidemia, cholestatic liver disease, nephrotic syndrome, hypothyroidism, obesity, atherosclerosis or a cardiovascular disease.

In an example, said disease or condition is hypercholesterolaemia. The term "hypercholesterolaemia," as used herein, refers to a condition in which cholesterol levels are elevated above a desired level. In some embodiments, this denotes that serum cholesterol levels are elevated. In some embodiments, the desired level takes into account various "risk factors" that are known to one of skill in the art (and are described or referenced in US20120093818).

The ligand of any preceding aspect, wherein the human is identified as heterozygous for Familial Hypercholesterolemia, statin intolerant, statin uncontrolled, or at risk for developing hypercholesterolemia, dyslipidemia, cholestatic liver disease, nephrotic syndrome, hypothyroidism, obesity, atherosclerosis or a cardiovascular disease.

In a Fifteenth Aspect: The ligand of any preceding aspect, wherein said disease or condition is associated with elevated LDL cholesterol.

Cholesterol levels are measured in milligrams (mg) of cholesterol per deciliter (dL) of blood in the United States and some other countries. Canada and most European countries measure cholesterol in millimoles (mmol) per liter (L) of blood. Below are general guideline ideal ranges and elevated ranges.

| Total cholesterol (U.S. and some other countries) | Total cholesterol* (Canada and most of Europe) | |
|---|---|---|
| Below 200 mg/dL | Below 5.2 mmol/L | Ideal |
| 200-239 mg/dL | 5.2-6.2 mmol/L | Borderline high |

-continued

| 240 mg/dL and above | Above 6.2 mmol/L | High |
|---|---|---|
| LDL cholesterol (U.S. and some other countries) | LDL cholesterol* (Canada and most of Europe) | |
| 100-129 mg/dL | 2.6-3.3 mmol/L | Ideal |
| 130-159 mg/dL | 3.4-4.1 mmol/L | Borderline high |
| 160-189 mg/dL | 4.1-4.9 mmol/L | High |
| 190 mg/dL and above | Above 4.9 mmol/L | Very high |

*Canadian and European guidelines differ slightly from U.S. guidelines. These conversions are based on U.S. guidelines.

Elevated LDL cholesterol is, therefore, 160 mg/dL or above (4.1 mmol/L or above).

In a Sixteenth Aspect: The ligand of any preceding aspect, wherein the ligand inhibits human PCSK9 binding to human LDL receptor and optionally has been or is determined as capable of such inhibition.

In an example, the method comprises (before administering the ligand) determining that the ligand is capable of such inhibition.

Inhibition determination is eg, inhibition in a blood or serum sample, at rtp, at ph7, at 37 degrees centigrade and/or under the physiological conditions of a human body.

In a Seventeeth Aspect: The ligand of any preceding aspect, wherein the human is resistant or substantially resistant to statin (eg, avorstatin and/or fluvastatin) treatment of said disease or condition.

In an Eighteenth Aspect: The ligand of any preceding aspect, wherein the ligand is for treating and/or preventing a PCSK9-mediated disease or condition in a human
(i) whose genome comprises SEQ ID NO: 29 and wherein the human is of ASW,YRI,GBR,TSI, CLM,LWK,MXL,JPT,PUR,IBS,FIN or CEU ancestry; or
(ii) whose genome comprises SEQ ID NO: 30 and wherein the human is of ASW,YRI,GBR,TSI,CLM, CHB,LWK,CHS, JPT,PUR,FIN or CEU ancestry; or
(iii) whose genome comprises SEQ ID NO: 32 and wherein the human is of ASW,GBR,TSI,CLM, JPT,PUR,IBS,FIN or CEU ancestry; or
(iv) whose genome comprises SEQ ID NO: 33 and wherein the human is of LWK,ASW,YRI or CLM ancestry; or
(v) whose genome comprises SEQ ID NO: 34 and wherein the human is of LWK,ASW or YRI ancestry; or
(vi) whose genome comprises SEQ ID NO: 35 and wherein the human is of PUR,TSI,FIN or CEU ancestry; or
(vii) whose genome comprises SEQ ID NO: 36 and wherein the human is of LWK,ASW or YRI ancestry; or
(viii) whose genome comprises SEQ ID NO: 37 and wherein the human is of CHS,ASW,JPT,PUR or CHB ancestry.

In a Ninteenth Aspect: The ligand of any preceding aspect, wherein the ligand is for treating and/or preventing a PCSK9-mediated disease or condition in a human
(i) that expresses PCSK9 formf and wherein the human is of ASW,YRI,GBR,TSI,CLM,LWK,MXL,JPT,PUR,IBS,FIN or CEU ancestry; or
(ii) that expresses PCSK9 form c and wherein the human is of ASW,YRI,GBR,TSI,CLM,CHB,LWK,CHS,JPT,PUR,FIN or CEU ancestry; or
(iii) that expresses PCSK9 form p and wherein the human is of ASW,GBR,TSI,CLM,JPT,PUR,IBS,FIN or CEU ancestry; or
(iv) that expresses PCSK9 form m and wherein the human is of LWK,ASW,YRI or CLM ancestry; or
(v) that expresses PCSK9 form e and wherein the human is of LWK,ASW or YRI ancestry; or
(vi) that expresses PCSK9 form h and wherein the human is of PUR,TSI,FIN or CEU ancestry; or
(vii) that expresses PCSK9 form aj and wherein the human is of LWK,ASW or YRI ancestry; or
(viii) that expresses PCSK9 form q and wherein the human is of CHS,ASW,JPT,PUR or CHB ancestry.

In an example, said forms are the mature forms.
In an example, said forms are the pro-forms.

In a Twentieth Aspect: A pharmaceutical composition or kit for treating and/or preventing a PCSK9-mediated condition or disease (eg, as recited in aspect 14 or 15), the composition or kit comprising a ligand of any preceding aspect and optionally a statin (eg, cerovastatin, atorvastatin, simvastatin, pitavastin, rosuvastatin, fluvastatin, lovastatin or pravastatin); and optionally in combination with a label or instructions for use to treat and/or prevent said disease or condition in a human (eg, covering treatment of a human as recited in aspect 18 or 19); optionally wherein the label or instructions comprise a marketing authorisation number (eg, an FDA or EMA authorisation number); optionally wherein the label or instructions comprise directions to administer alirocumab or evolocumab to said human; optionally wherein the kit comprises an IV or injection device that comprises the ligand (and, eg, also a statin).

In a Twenty-first Aspect: A method of producing an anti-human PCSK9 antibody binding site, the method comprising obtaining a plurality of anti-PCSK9 antibody binding sites, screening the antibody binding sites for binding to (i) a PCSK9 of said alternative or (ii) a human PCSK9 selected from the group consisting of forms f, c, r, p, m, e, h, aj and q or a catalytic or C-terminal domain or a peptide thereof that comprises amino acid variation from the corresponding sequence of SEQ ID NO: 1, 2 or 3 and isolating an antibody binding site that binds in the screening step, and optionally producing a form f, c, r, p, m, e, h, aj or q PCSK9-binding fragment or derivative of the isolated antibody.

In an example, said forms are the mature forms.
In an example, said forms are the pro-forms.

In an example of this and the next aspect, the plurality of binding sites comprises or consists of a plurality of 4-chain antibodies or fragments thereof, eg, dAbs, Fabs or scFvs. Suitable methods for producing pluralities of binding sites for screening include phage display (producing a phage display library of antibody binding sites), ribosome display (producing a ribosome display library of antibody binding sites), yeast display (producing a yeast display library of antibody binding sites), or immunisation of a non-human vertebrate (eg, a rodent, eg, a mouse or rat, eg, a Velocimouse™, Kymouse™, Xenomouse™, Aliva Mouse™, HuMab Mouse™, Omnimouse™ Omnirat™ or MeMo Mouse™) with a PCSK9 epitope and isolation of a repertoire of antibody-producing cells (eg, a B-cell, plasma cell or plasmablast repertoire) and/or a repertoire of isolated antibodies.

In an example, the method comprises selecting one or more antibody binding sites that each specifically binds to a human PCSK9 epitope comprising amino acid variation from the corresponding sequence of SEQ ID NO: 1, 2 or 3.

In a Twenty-second Aspect: A method of producing an anti-human PCSK9 antibody, the method comprising immunising a non-human vertebrate (eg, a mouse or a rat) with (i) a PCSK9 of said alternative or (ii) a human PCSK9 comprising an amino acid sequence selected from the group consisting of the amino acid sequences of forms f, c, r, p, m, e, h, aj and q or a catalytic or C-terminal domain or a peptide thereof that comprises amino acid variation from the corresponding sequence of SEQ ID NO: 1, 2 or 3 and isolating an antibody that binds a human PCSK9 comprising selected from the group consisting of forms f, c, r, p, m, e, h, aj and q or a catalytic or C-terminal domain or a peptide thereof that comprises amino acid variation from the corresponding sequence of SEQ ID NO: 1, 2 or 3, and optionally producing a form f c, r p, m, e, h, aj or q PCSK9-binding fragment or derivative of the isolated antibody.

In an example, said forms are the mature forms.

In an example, said forms are the pro-forms.

In a Twenty-third Aspect: The method of aspect 21 or 22, comprising the step of obtaining a nucleic acid encoding the antibody, fragment, derivative or binding site and optionally inserting the nucleic acid in an expression vector.

For example, the method comprises isolating a cell (eg, B-cell, plasmablast, plasma cell or memory cell) comprising the nucleic acid, wherein the cell is obtained from a non-human vertebrate that has been immunised with the PCSK9 epitope.

In a Twenty-fourth Aspect: A kit for PCSK9 genotyping a human, wherein the kit comprises a nucleic acid (i) comprising a sequence of 10 or more (eg, 10, 15, 20, 30, 40, 50, 60, 70, 80, 90, 100 or more) contiguous nucleotides that specifically hybridises to (i) a nucleotide sequence encoding a PCSK9 of said alternative or (ii) a nucleotide sequence selected from the group consisting of SEQ ID NOs: 29-37 or at least the catalytic domain- or C-terminal domain-encoding sequence thereof, or specifically hybridises to an antisense sequence or an RNA transcript of said sequence, wherein said sequence of contiguous nucleotides hybridises to at least one nucleotide present in said selected sequence which is not present in SEQ ID NO: 28 or hybridises to an antisense sequence or an RNA transcript thereof; and/or (ii) comprising a sequence of at least 10 or more (eg, 10, 15, 20, 30, 40, 50, 60, 70, 80, 90, 100 or more) nucleotides of a nucleotide sequence selected from the group consisting of SEQ ID NOs: 29-37 (or the nucleotide sequence of (i)) or comprising an antisense sequence or RNA version of said contiguous nucleotides, wherein said sequence of contiguous nucleotides comprises at least one nucleotide present in said selected sequence which is not present in SEQ ID NO: 28.

In an example, the nucleotide sequence is selected from the group consisting of SEQ ID NOs: 29-35 and 37; or selected from the group consisting of SEQ ID NOs: 29-32 and 34-37; or selected from the group consisting of SEQ ID NOs: 29-32, 34, 35 and 37. These are naturally-occurring allele (haplotype) sequences that do not encode 46L and which meet the criteria set out above. These groups comprise variants that are associated with elevated LDL-C.

In an example, the nucleotide sequence is SEQ ID NO: 34, that encodes a 425S, which is associated with elevated LDL-C (Pisciotta et al 2006).

In an example, the nucleotide sequence selected from the group consisting of SEQ ID NOs: 31 and 37, that encode 670G which is a marker for severity of coronary atherosclerosis (Chen et al 2005).

In an example, the nucleotide sequence selected from the group consisting of SEQ ID NOs: 31, 32, 34, 35, 36 and 37; or selected from the group consisting of SEQ ID NOs: 31, 32, 34, 35 and 37. These are allele (haplotype) sequences that have a naturally-occurring combination of differences from SEQ ID NO: 28 (form a) and which meet the criteria set out above.

In an example, the nucleotide sequence is SEQ ID NO: 29.
In an example, the nucleotide sequence is SEQ ID NO: 30.
In an example, the nucleotide sequence is SEQ ID NO: 31.
In an example, the nucleotide sequence is SEQ ID NO: 32.
In an example, the nucleotide sequence is SEQ ID NO: 33.
In an example, the nucleotide sequence is SEQ ID NO: 34.
In an example, the nucleotide sequence is SEQ ID NO: 35.
In an example, the nucleotide sequence is SEQ ID NO: 36.
In an example, the nucleotide sequence is SEQ ID NO: 37.

In a Twenty-fifth Aspect: A kit for PCSK9 genotyping or phenotyping a human, wherein the kit comprises a ligand according to any one of aspects 1 to 19 or an antibody, fragment or derivative produced by the method of any one of aspects 21 to 23.

In a Twenty-sixth Aspect: Use of an anti-PCSK9 ligand that binds (i) a PCSK9 of said alternative or (ii) a human PCSK9 selected from the group consisting of forms f, c, r, p, m, e, h, aj and q in the manufacture of a medicament for treating and/or preventing a PCSK9-mediated disease or condition in a human whose genome comprises (iii) a nucleotide sequence encoding said PCSK9 of (i); or (iv) a nucleotide sequence selected from the group consisting of SEQ ID NOs: 29-37, optionally for treating and/or preventing a PCSK9-mediated disease or condition in a human as recited in aspect 18 or 19.

In an example, said forms are the mature forms.

In an example, said forms are the pro-forms.

In a Twenty-seventh Aspect: Use of an anti-PCSK9 ligand that binds (i) a PCSK9 of said alternative or (ii) a human PCSK9 selected from the group consisting of forms f, c, r, p, m, e, h, aj and q in the manufacture of a medicament for targeting said PCSK9 in a human to treat and/or prevent a disease or condition mediated by PCSK9, optionally for targeting PCSK9 in a human as recited in aspect 18 or 19.

In an example, said forms are the mature forms.

In an example, said forms are the pro-forms.

In an example, the nucleotide sequence is selected from the group consisting of SEQ ID NOs: 29-35 and 37; or selected from the group consisting of SEQ ID NOs: 29-32 and 34-37; or selected from the group consisting of SEQ ID NOs: 29-32, 34, 35 and 37. These are naturally-occurring allele (haplotype) sequences that do not encode 46L and which meet the criteria set out above. These groups comprise variants that are associated with elevated LDL-C.

In an example, the nucleotide sequence is SEQ ID NO: 34, that encodes a 425S, which is associated with elevated LDL-C (Pisciotta et al 2006).

In an example, the nucleotide sequence selected from the group consisting of SEQ ID NOs: 31 and 37, that encode 670G which is a marker for severity of coronary atherosclerosis (Chen et al 2005).

In an example, the nucleotide sequence selected from the group consisting of SEQ ID NOs: 31, 32, 34, 35, 36 and 37; or selected from the group consisting of SEQ ID NOs: 31, 32, 34, 35 and 37. These are allele (haplotype) sequences that have a naturally-occurring combination of differences from SEQ ID NO: 28 (form a) and which meet the criteria set out above.

In an example, the nucleotide sequence is SEQ ID NO: 29.
In an example, the nucleotide sequence is SEQ ID NO: 30.
In an example, the nucleotide sequence is SEQ ID NO: 31.
In an example, the nucleotide sequence is SEQ ID NO: 32.
In an example, the nucleotide sequence is SEQ ID NO: 33.
In an example, the nucleotide sequence is SEQ ID NO: 34.
In an example, the nucleotide sequence is SEQ ID NO: 35.
In an example, the nucleotide sequence is SEQ ID NO: 36.
In an example, the nucleotide sequence is SEQ ID NO: 37.

The ligand can be any anti-PCSK9 ligand disclosed herein.

In a Twenty-eight Aspect: The use of aspect 26 or 27, wherein the ligand, human, disease or condition is according to any one of aspects 1 to 19.

In a Twenty-ninth Aspect: A method of targeting a PCSK9 for treating and/or preventing a PCSK9-mediated disease or condition in a human, the method comprising administering an anti-PCSK9 ligand to a human comprising (i) a nucleotide sequence encoding a PCSK9 of said alternative or (ii) a nucleotide sequence selected from the group consisting SEQ ID NOs: 29-37, whereby a PCSK9 encoded by said nucleotide sequence is targeted.

The ligand can be any anti-PCSK9 ligand disclosed herein.

In a Thirtieth Aspect: The method of aspect 29, wherein the method comprises targeting a human PCSK9 selected from the group consisting of forms f, c, r, p, m, e, h, aj and q with said ligand to treat and/or prevent said disease or condition in said human.

In an example, said forms are the mature forms.

In an example, said forms are the pro-forms.

In a Thirty-first Aspect: A method of treating and/or preventing a disease or condition mediated by PCSK9 in a human, the method comprising targeting (i) a PCSK9 of said alternative or (ii) a human PCSK9 selected from the group consisting of forms f, c, r, p, m, e, h, aj and q by administering to the human a ligand that binds said PCSK9 thereby treating and/or preventing said disease or condition in the human.

In an example, said forms are the mature forms.

In an example, said forms are the pro-forms.

The ligand can be any anti-PCSK9 ligand disclosed herein.

In a Thirty-second Aspect: The method of aspect 31, wherein the genome of the human comprises a nucleotide sequence selected from the group consisting of SEQ ID NOs: 29-37.

In an example, the nucleotide sequence is selected from the group consisting of SEQ ID NOs: 29-35 and 37; or selected from the group consisting of SEQ ID NOs: 29-32 and 34-37; or selected from the group consisting of SEQ ID NOs: 29-32, 34, 35 and 37. These are naturally-occurring allele (haplotype) sequences that do not encode 46L and which meet the criteria set out above. These groups comprise variants that are associated with elevated LDL-C.

In an example, the nucleotide sequence is SEQ ID NO: 34, that encodes a 425S, which is associated with elevated LDL-C (Pisciotta et al 2006).

In an example, the nucleotide sequence selected from the group consisting of SEQ ID NOs: 31 and 37, that encode 670G which is a marker for severity of coronary atherosclerosis (Chen et al 2005).

In an example, the nucleotide sequence selected from the group consisting of SEQ ID NOs: 31, 32, 34, 35, 36 and 37; or selected from the group consisting of SEQ ID NOs: 31, 32, 34, 35 and 37. These are allele (haplotype) sequences that have a naturally-occurring combination of differences from SEQ ID NO: 28 (form a) and which meet the criteria set out above.

In an example, the nucleotide sequence is SEQ ID NO: 29.
In an example, the nucleotide sequence is SEQ ID NO: 30.
In an example, the nucleotide sequence is SEQ ID NO: 31.
In an example, the nucleotide sequence is SEQ ID NO: 32.
In an example, the nucleotide sequence is SEQ ID NO: 33.
In an example, the nucleotide sequence is SEQ ID NO: 34.
In an example, the nucleotide sequence is SEQ ID NO: 35.
In an example, the nucleotide sequence is SEQ ID NO: 36.
In an example, the nucleotide sequence is SEQ ID NO: 37.

In a Thirty-third Aspect: The method of any one of aspects 29 to 32, wherein the human has been or is genotyped as positive for a nucleotide sequence selected from the group consisting of SEQ ID NOs: 29-37 or the catalytic- or C-terminal domain-encoding sequence thereof.

In a Thirty-fourth Aspect: The method of any one of aspects 29 to 33, wherein the human has been or is phenotyped as positive for (i) a PCSK9 of said alternative or (ii) a human PCSK9 selected from the group consisting of forms f, c, r, p, m, e, h, aj and q.

In an example, said forms are the mature forms.

In an example, said forms are the pro-forms.

In a Thirty-fifth Aspect: The method of any one of aspects 29 to 34, wherein the method comprises genotyping the human as positive for (i) a nucleotide sequence encoding a PCSK9 of said alternative or (ii) a nucleotide sequence selected from the group consisting of SEQ ID NOs: 29-37 or the catalytic- or C-terminal domain-encoding sequence thereof.

In a Thirty-sixth Aspect: The method of any one of aspects 29 to 35, wherein the method comprises phenotyping the human as positive for (i) a PCSK9 of said alternative or (ii) a human PCSK9 sequence selected from the group consisting of forms f, c, r, p, m, e, h, aj and q.

In an example, said forms are the mature forms.

In an example, said forms are the pro-forms.

In a Thirty-seventh Aspect: The method of any one of aspects 29 to 36, wherein the human has been or is genotyped as heterozygous for said nucleotide sequence of (i) or a nucleotide sequence selected from the group consisting of SEQ ID NOs: 29-37 or the catalytic- or C-terminal domain-encoding sequence thereof; optionally wherein the human has been or is genotyped as comprising the nucleotide sequence of SEQ ID NO: 28 or the catalytic- or C-terminal domain-encoding sequence thereof and said nucleotide sequence of (i) or a nucleotide sequence selected from the group consisting of SEQ ID NOs: 29-37 or the catalytic- or C-terminal domain-encoding sequence thereof.

In a Thirty-eighth Aspect: The method of any one of aspects 29 to 37, wherein the genome of the human has been or is genotyped as homozygous for said nucleotide sequence of (i) or a nucleotide sequence selected from the group consisting of of SEQ ID NOs: 29-37 or the catalytic- or C-terminal domain-encoding sequence thereof.

In a Thirty-ninth Aspect: The method of any one of aspects 29 to 38, wherein the method comprises genotyping the human for said nucleotide sequence of (i) or a nucleotide sequence selected from the group consisting of SEQ ID NOs: 29-37 or the catalytic- or C-terminal domain-encoding sequence thereof before administering the ligand to the human, wherein the ligand is determined to be capable of binding to a PCSK9 encoded by said selected sequence.

In a Fortieth Aspect: The method of any one of aspects 29 to 39, wherein the ligand, human, disease or condition is according to any one of aspects 1 to 19.

In a Forty-first Aspect: A method according to any one of aspects 29 to 40 for treating and/or preventing a condition or disease as recited in aspect 14 or 15, the method comprising administering said ligand and a statin (eg, cerovastatin, atorvastatin, simvastatin, pitavastin, rosuvastatin, fluvastatin, lovastatin or pravastatin) to the human.

In a Forty-second Aspect: The method of aspect 41, wherein the ligand and statin are administered separately.

In a Forty-third Aspect: The method of aspect 41, wherein the ligand and statin are administered simultaneously.

In a Forty-fourth Aspect: The method of any one of aspects 29 to 43, wherein the ligand is administered by subcutaneous injection.

In a Forty-fifth Aspect: A method of PCSK9 genotyping a nucleic acid sample of a human, the method comprising identifying in the sample the presence of (i) a nucleotide sequence enoding a PCSK9 of said alternative or (ii) a nucleotide sequence selected from the group consisting of SEQ ID NOs: 29-37 or the catalytic- or C-terminal domain-encoding sequence thereof.

In a Forty-sixth Aspect: A method of PCSK9 typing a protein sample of a human, the method comprising identifying in the sample the presence of (i) a PCSK9 of said alternative or (ii) a human PCSK9 selected from the group consisting of forms f, c, r, p, m, e, h, aj and q.

In an example, said forms are the mature forms.

In an example, said forms are the pro-forms.

In a Forty-seventh Aspect: The method of aspect 45 or 46, comprising obtaining a sample of serum, blood, feces, hair, tissue, cells, urine or saliva from a human, whereby the nucleic acid or protein sample is obtained and used in the step of identifying said sequence.

In a Forty-eighth Aspect: The method of any one of aspects 45 to 47, comprising using a ligand according to any one of aspects 1 to 19 to carry out said identifying step.

In a Forty-ninth Aspect: A method of treating and/or preventing in a human patient a cardiovascular disease or condition, or a disease or condition that is associated with elevated LDL cholesterol (eg, hypercholesterolaemia), wherein the patient is receiving or has previously received statin treatment for said disease or condition, the method comprising typing the patient using a method of any one of aspects 45 to 48 and administering a ligand according to one of aspects 1 to 19 whereby the human is treated or said disease or condition is prevented; optionally also reducing or stopping statin treatment.

In an example, said reducing or stopping comprises reducing the dose and/or dosing frequency of statin.

In a Fiftieth Aspect: A diagnostic, therapeutic or prophylactic kit comprising a ligand that is capable of binding to or has been or is determined as capable of binding to an amino acid sequence selected from SEQ ID NOs: 4-27 and instructions for carrying out the method of any one of aspects 46 to 49 and/or a label or instructions indicating or covering administration of the ligand to a human as defined in any one of aspects 1 to 19.

In a Fifty-first Aspect: A diagnostic, therapeutic or prophylactic kit comprising a nucleic acid probe comprising a nucleotide sequence that specifically hybridises to a nucleotide sequence or (i) or a nucleotide sequence selected from the group consisting of SEQ ID NOs: 29-37 or an antisense sequence or RNA transcript thereof and instructions for carrying out the method of aspect 45, 47 or 48.

In examples of the present invention, the ligand specifically binds to human PCSK9, eg, one or more of (i) the PCSK9s of said alternative or (ii) the rare PCSK9 variants disclosed herein (eg, one, two, three, more or all mature forms f, c, r, p, m, e, h, aj and q) and optionally also the a and/or a' form. For example, the ligand specifically binds to mature form f and/or c as well as form a. For example, the ligand specifically binds to a human PCSK9 comprising a mutation E670G and also binds to a human PCSK9 comprising a mutation I474V, Q619P or N425S in SEQ ID NO: 1. For example, the ligand specifically binds to a human PCSK9 comprising a mutation E670G and also binds to a human PCSK9 comprising a mutation I474V in SEQ ID NO: 1. For example, the ligand specifically binds to a human PCSK9 comprising a mutation E670G and also binds to a human PCSK9 comprising a mutation Q619P in SEQ ID NO: 1. For example, the ligand specifically binds to a human PCSK9 comprising a mutation E670G and also binds to a human PCSK9 comprising a mutation N425S in SEQ ID NO: 1. Determination of such binding can be performed by any antibody binding test as known in the art, eg, by surface plasmon resonance. Binding to each such form is, for example, respectively with a Kd of at least 1 mM, 100 nM, 1 nM, 100 pM, 10 pM or 1 pM.

In an example, the ligand binds form a and (i) a PCSK9 of said alternative or (ii) a PCSK9 selected from the group consisting of forms f, c, r, p, m, e, h, aj and q, wherein the ligand binding to said selected form is with a Kd (determined by SPR) that is at least 60, 70, 80, 90 or 95% of the Kd for binding to form a. In an embodiment, both forms are mature forms. In an embodiment, both forms are pro-forms.

In an example, the ligand binds form a and form f, wherein the ligand binding to form f is with a Kd (determined by SPR) that is at least 60, 70, 80, 90 or 95% of the Kd for binding to form a. In an embodiment, both forms are mature forms. In an embodiment, both forms are pro-forms.

In an example, the ligand binds form a and form c, wherein the ligand binding to form c is with a Kd (determined by SPR) that is at least 60, 70, 80, 90 or 95% of the Kd for binding to form a. In an embodiment, both forms are mature forms. In an embodiment, both forms are pro-forms.

In an example, the ligand binds form a and form r, wherein the ligand binding to form r is with a Kd (determined by SPR) that is at least 60, 70, 80, 90 or 95% of the Kd for binding to form a. In an embodiment, both forms are mature forms. In an embodiment, both forms are pro-forms.

In an example, the ligand binds form a and form p, wherein the ligand binding to form p is with a Kd (determined by SPR) that is at least 60, 70, 80, 90 or 95% of the Kd for binding to form a. In an embodiment, both forms are mature forms. In an embodiment, both forms are pro-forms.

In an example, the ligand binds form a and form m, wherein the ligand binding to form m is with a Kd (determined by SPR) that is at least 60, 70, 80, 90 or 95% of the Kd for binding to form a. In an embodiment, both forms are mature forms. In an embodiment, both forms are pro-forms.

In an example, the ligand binds form a and form e, wherein the ligand binding to form e is with a Kd (determined by SPR) that is at least 60, 70, 80, 90 or 95% of the Kd for binding to form a. In an embodiment, both forms are mature forms. In an embodiment, both forms are pro-forms.

In an example, the ligand binds form a and form h, wherein the ligand binding to form h is with a Kd (determined by SPR) that is at least 60, 70, 80, 90 or 95% of the Kd for binding to form a. In an embodiment, both forms are mature forms. In an embodiment, both forms are pro-forms.

In an example, the ligand binds form a and form aj, wherein the ligand binding to form aj is with a Kd (determined by SPR) that is at least 60, 70, 80, 90 or 95% of the Kd for binding to form a. In an embodiment, both forms are mature forms. In an embodiment, both forms are pro-forms.

In an example, the ligand binds form a and form q, wherein the ligand binding to form q is with a Kd (determined by SPR) that is at least 60, 70, 80, 90 or 95% of the Kd for binding to form a. In an embodiment, both forms are mature forms. In an embodiment, both forms are pro-forms.

In examples of the present invention, the ligand neutralises human PCSK9, eg, one or more of the rare PCSK9 variants disclosed herein (eg, one, two, three, more or all mature forms f, c, r, p, m, e, h, aj and q) and optionally also the a and/or a' form. For example, the ligand neutralises mature form f and/or c as well as form a. Determination of neutralisation can be performed, for example, by any neutralisation assay method disclosed in US20120093818A1 (Amgen, Inc) or US20110065902A1 (Regeneron Pharmaceuticals, Inc). Ligands of the invention that bind or target PCSK9 are useful, for example, for therapeutic and prophylactic applications disclosed in US20120093818A1 and US20110065902A1, these specific disclosures being incorporated herein by reference for use in the present invention and for possible inclusion in claims herein.

In embodiments where the ligand is used for therapeutic applications, an antigen binding protein can inhibit, interfere with or modulate one or more biological activities of a PCSK9 (eg, one or more of the rare variants disclosed herein and optionally also the a and/or a' form). In one embodiment, ligand binds specifically to human PCSK9 (eg, one or more of the rare variants disclosed herein and optionally also the a and/or a' form) and/or substantially inhibits binding of human PCSK9 (eg, said one or more of the rare variants disclosed herein and optionally also the a and/or a' form) to LDLR by at least 20%, eg, 20%-40%, 40-60%, 60-80%, 80-85%, or more (for example, by measuring binding in an in vitro competitive binding assay). In an example, the ligand is an antibody.

In an embodiment, the ligand has a Kd of less (binding more tightly) than $10^{-7}$, $10^{-8}$, $10^{-9}$, $10^{-10}$, $10^{-11}$, $10^{-12}$, $10^{-13}$ M for binding to one, two or more of the rare variants disclosed herein and optionally also the a and/or a' form. In an example, Kd is determined using SPR.

In an embodiment, the ligand has an IC50 for blocking the binding of LDLR to one or more of the rare PCSK9 variants disclosed herein (and optionally also the a and/or a' form) of less than 1 microM, 1000 nM to 100 nM, 100 nM to 10 nM, 10 nM to 1 nM, 1000 pM to 500 pM, 500 pM to 200 pM, less than 200 pM, 200 pM to 150 pM, 200 pM to 100 pM, 100 pM to 10 pM, 10 pM to 1 pM.

In an embodiment, the ligand has an IC50 for blocking the binding of LDLR to the a and/or a' form of PCSK9 that is no more than 1000, 100, 90, 80, 70, 60, 50, 40, 30, 20 or 10-fold more (ie, more inhibitory) than the IC50 for blocking the binding of LDLR to one or more of the rare PCSK9 variants disclosed herein (eg, one or more PCSK9 proteins comprising a sequence selected from SEQ ID NOs: 4 to 27). Additionally or alternatively, for example, the ligand has an IC50 for blocking the binding of LDLR to (i) the a and/or a' form of less than 1 microM, 1000 nM to 100 nM, 100 nM to 10 nM, 10 nM to 1 nM, 1000 pM to 500 pM, 500 pM to 200 pM, less than 200 pM, 200 pM to 150 pM, 200 pM to 100 pM, 100 pM to 10 pM, 10 pM to 1 pM, eg, in the range of 1 mM to 1 pM (eg, 1 mM to 100 pM; 10 nM to 100 pM; 1 nM to 10 pM; or 100 pM to 1 pM) and (ii) one or more PCSK9 proteins comprising a sequence selected from SEQ ID NOs: 4 to 27 of less than 1 microM, 1000 nM to 100 nM, 100 nM to 10 nM, 10 nM to 1 nM, 1000 pM to 500 pM, 500 pM to 200 pM, less than 200 pM, 200 pM to 150 pM, 200 pM to 100 pM, 100 pM to 10 pM, 10 pM to 1 pM, eg, in the range of 1 mM to 1 pM (eg, 1 mM to 100 pM; 10 nM to 100 pM; 1 nM to 10 pM; or 100 pM to 1 pM).

In an embodiment, the ligand binds to the a and/or a' form of PCSK9 with a binding affinity (Kd) that is greater than up to 10%, greater than up to 20%, greater than up to 40%, greater than up to 50%, greater than up to 55%, greater than up to 60%, greater than up to 65%, greater than up to 70%, greater than up to 75%, greater than up to 80%, greater than up to 85%, greater than up to 90%, greater than up to 95% or greater than up to 100% (ie, is double) relative to binding to a PCSK9 comprising a sequence selected from SEQ ID NOs: 4 to 27. Such binding measurements can be made using a variety of binding assays known in the art, eg, using surface plasmon resonance (SPR), such as by Biacore™ or using the ProteOn XPR36™ (Bio-Rad®), or using KinExA® (Sapidyne Instruments, Inc).

In one embodiment, the surface plasmon resonance (SPR) is carried out at 25° C. In another embodiment, the SPR is carried out at 37° C.

In one embodiment, the SPR is carried out at physiological pH, such as about pH7 or at pH7.6 (eg, using Hepes buffered saline at pH7.6 (also referred to as HBS-EP)).

In one embodiment, the SPR is carried out at a physiological salt level, eg, 150 mM NaCl.

In one embodiment, the SPR is carried out at a detergent level of no greater than 0.05% by volume, eg, in the presence of P20 (polysorbate 20; eg, Tween-20TM) at 0.05% and EDTA at 3 mM.

In one example, the SPR is carried out at 25° C. or 37° C. in a buffer at pH7.6, 150 mM NaCl, 0.05% detergent (eg, P20) and 3 mM EDTA. The buffer can contain 10 mM Hepes. In one example, the SPR is carried out at 25° C. or 37° C. in HBS-EP. HBS-EP is available from Teknova Inc (California; catalogue number H8022).

In an example, the affinity of the ligand which is an antibody is determined using SPR by 1. Coupling anti-mouse (or other relevant vertebrate) IgG (eg, Biacore BR-1008-38) to a biosensor chip (eg, GLM chip) such as by primary amine coupling;
2. Exposing the anti-mouse IgG (vertebrate antibody) to a test IgG antibody to capture test antibody on the chip;
3. Passing the test antigen over the chip's capture surface at 1024 nM, 256 nM, 64 nM, 16 nM, 4 nM with a 0 nM (i.e. buffer alone); and
4. And determining the affinity of binding of test antibody to test antigen using surface plasmon resonance, eg, under an SPR condition discussed above (eg, at 25° C. in physiological buffer). SPR can be carried out using any standard SPR apparatus, such as by Biacore™ or using the ProteOn XPR36™ (Bio-Rad®).

Regeneration of the capture surface can be carried out with 10 mM glycine at pH1.7. This removes the captured antibody and allows the surface to be used for another interaction. The binding data can be fitted to 1:1 model inherent using standard techniques, eg, using a model inherent to the ProteOn XPR36™ analysis software.

In an embodiment, assaying or testing of a ligand of the invention is carried out at or substantially at pH7 (eg, for in vitro tests and assays) and at or substantially at rtp.

One example of an IgG2 heavy chain constant domain of an anti-PCSK9 antibody of the present invention has the amino acid sequence as shown in SEQ ID NO: 154, FIG. 3KK of US20120093818A1, which sequence is incorporated herein by reference.

One example of an IgG4 heavy chain constant domain of an anti-PCSK9 antibody of the present invention has the amino acid sequence as shown in SEQ ID NO: 155, FIG. 3KK of US20120093818A1, which sequence is incorporated herein by reference.

One example of a kappa light chain constant domain of an anti-PCSK9 antibody has the amino acid sequence as shown in SEQ ID NO: 157, FIG. 3KK which sequence is incorporated herein by reference.

One example of a lambda light chain constant domain of an anti-PCSK9 antibody has the amino acid sequence as shown in SEQ ID NO: 156, FIG. 3KK of US20120093818A1, which sequence is incorporated herein by reference.

In examples of the present invention, the ligand binds mature PCSK9, eg, a mature form of one or more of the rare variants disclosed herein and optionally also the a and/or a' form.

In examples of the present invention, the ligand binds the catalytic domain of PCSK9, eg, of a mature form of one or more of the rare variants disclosed herein and optionally also the a and/or a' form.

In examples of the present invention, the ligand binds the prodomain of PCSK9, eg, of a mature form of one or more of the rare variants disclosed herein and optionally also the a and/or a' form.

In some embodiments, the ligand binds to the V domain of PCSK9, eg, of a mature form of one or more of the rare variants disclosed herein and optionally also the a and/or a' form. In some embodiments, the ligand binds to the V domain of PCSK9 (eg, of a mature form of one or more of the rare variants disclosed herein and optionally also the a and/or a' form) and prevents (or reduces, eg, by at least 10%) PCSK9 from binding to LDLR. In some embodiments, the ligand binds to the V domain of PCSK9 (eg, of a mature form of one or more of the rare variants disclosed herein and optionally also the a and/or a' form), and while it does not prevent (or reduce) the binding of PCSK9 to LDLR, the ligand prevents or reduces (eg, by at least 10%) the adverse activities mediated through PCSK9 on LDLR.

In examples of the present invention, the ligand is or comprises a fully human antibody. In an example, the ligand comprises human variable regions or humanised variable regions.

In an example, the ligand of the invention specifically binds to an epitope of (i) a PCSK9 of said alternative or (ii) a human PCSK9 selected from the group consisting of forms f, c, i p, m, e, h, aj and q, wherein the epitope comprises at least one amino acid that is not found in form a. For example, the amino acid is selected from the group consisting of 46L, 53V, 425S, 443T, 474V, 619P and 670G (numbering as used in SEQ ID NO:1). For example, the amino acid is selected from the group consisting of 425S, 443T, 474V, 619P and 670G (numbering as used in SEQ ID NO:1). For example, the amino acid is selected from the group consisting of 425S and 443T (numbering as used in SEQ ID NO:1). For example, the amino acid is selected from the group consisting of 474V, 619P and 670G (numbering as used in SEQ ID NO:1). In an example, the PCSK9 form is the mature form. In an example, the PCSK9 form is the pro-form. In an example, the ligand also specifically binds to form a and/or a'. In an embodiment, the ligand specifically binds to an epitope of form f PCSK9, wherein the epitope comprises at least one amino acid that is not found in form a. In an embodiment, the ligand specifically binds to an epitope of form c PCSK9, wherein the epitope comprises at least one amino acid that is not found in form a. In an embodiment, the ligand specifically binds to an epitope of form r PCSK9, wherein the epitope comprises at least one amino acid that is not found in form a. In an embodiment, the ligand specifically binds to an epitope of form p PCSK9, wherein the epitope comprises at least one amino acid that is not found in form a. In an embodiment, the ligand specifically binds to an epitope of form m PCSK9, wherein the epitope comprises at least one amino acid that is not found in form a. In an embodiment, the ligand specifically binds to an epitope of form e PCSK9, wherein the epitope comprises at least one amino acid that is not found in form a. In an embodiment, the ligand specifically binds to an epitope of form h PCSK9, wherein the epitope comprises at least one amino acid that is not found in form a. In an embodiment, the ligand specifically binds to an epitope of form aj PCSK9, wherein the epitope comprises at least one amino acid that is not found in form a. In an embodiment, the ligand specifically binds to an epitope of form q PCSK9, wherein the epitope comprises at least one amino acid that is not found in form a.

In an embodiment, ligand binds specifically to the prodomain of a human PCSK9 selected from the group consisting of forms f, c, r, p, m, e, h, aj and q. In an example, the ligand also specifically binds to the pro-domain of form a and/or a'. In an embodiment, the ligand specifically binds to the pro-domain of form f PCSK9, wherein the epitope comprises at least one amino acid that is not found in form a. In an embodiment, the ligand specifically binds to the pro-domain of form c PCSK9, wherein the epitope comprises at least one amino acid that is not found in form a. In an embodiment, the ligand specifically binds to the pro-domain of form r PCSK9, wherein the epitope comprises at least one amino acid that is not found in form a. In an embodiment, the ligand specifically binds to the pro-domain of form p PCSK9, wherein the epitope comprises at least one amino acid that is not found in form a. In an embodiment, the ligand specifically binds to the pro-domain of form m PCSK9, wherein the epitope comprises at least one amino acid that is not found in form a. In an embodiment, the ligand specifically binds to the pro-domain of form e PCSK9, wherein the epitope comprises at least one amino acid that is not found in form a. In an embodiment, the ligand specifically binds to the pro-domain of form h PCSK9, wherein the epitope comprises at least one amino acid that is not found in form a. In an embodiment, the ligand specifically binds to the pro-domain of form aj PCSK9, wherein the epitope comprises at least one amino acid that is not found in form a. In an embodiment, the ligand specifically binds to the pro-domain of form q PCSK9, wherein the epitope comprises at least one amino acid that is not found in form a.

In an embodiment, ligand binds specifically to the catalytic domain of a human PCSK9 selected from the group consisting of forms f, c, r, p, m, e, h, aj and q. In an example, the ligand also specifically binds to the catalytic domain of form a and/or a'. In an embodiment, the ligand specifically binds to the catalytic domain of formfPCSK9, wherein the epitope comprises at least one amino acid that is not found in form a. In an embodiment, the ligand specifically binds to the catalytic domain of form c PCSK9, wherein the epitope comprises at least one amino acid that is not found in form a. In an embodiment, the ligand specifically binds to the catalytic domain of form r PCSK9, wherein the epitope comprises at least one amino acid that is not found in form a. In an embodiment, the ligand specifically binds to the catalytic domain of form p PCSK9, wherein the epitope comprises at least one amino acid that is not found in form a. In an embodiment, the ligand specifically binds to the catalytic domain of form m PCSK9, wherein the epitope comprises at least one amino acid that is not found in form a. In an embodiment, the ligand specifically binds to the catalytic domain of form e PCSK9, wherein the epitope comprises at least one amino acid that is not found in form a. In an embodiment, the ligand specifically binds to the catalytic domain of form h PCSK9, wherein the epitope comprises at least one amino acid that is not found in form a. In an embodiment, the ligand specifically binds to the catalytic domain of form aj PCSK9, wherein the epitope comprises at least one amino acid that is not found in form a. In an embodiment, the ligand specifically binds to the catalytic domain of form q PCSK9, wherein the epitope comprises at least one amino acid that is not found in form a.

In an embodiment, ligand binds specifically to the C-terminal domain of a human PCSK9 selected from the group consisting of forms f, c, r, p, m, e, h, aj and q. In an example, the ligand also specifically binds to the C-terminal domain of form a and/or a'. In an embodiment, the ligand specifically binds to the C-terminal domain of formfPCSK9, wherein the epitope comprises at least one amino acid that is not found in form a. In an embodiment, the ligand specifically binds to the C-terminal domain of form c PCSK9, wherein the epitope comprises at least one amino acid that is not found in form a. In an embodiment, the ligand specifically binds to the C-terminal domain of form r PCSK9, wherein the epitope comprises at least one amino acid that is not found in form a. In an embodiment, the ligand specifically binds to the C-terminal domain of form p PCSK9, wherein the epitope comprises at least one amino acid that is not found in form a. In an embodiment, the ligand specifically binds to the C-terminal domain of form m PCSK9, wherein the epitope comprises at least one amino acid that is not found in form a. In an embodiment, the ligand specifically binds to the C-terminal domain of form e PCSK9, wherein the epitope comprises at least one amino acid that is not found in form a. In an embodiment, the ligand specifically binds to the C-terminal domain of form h PCSK9, wherein the epitope comprises at least one amino acid that is not found in form a. In an embodiment, the ligand specifically binds to the C-terminal domain of form aj PCSK9, wherein the epitope comprises at least one amino acid that is not found in form a. In an embodiment, the ligand specifically binds to the C-terminal domain of form q PCSK9, wherein the epitope comprises at least one amino acid that is not found in form a.

In an embodiment, ligand binds specifically to the substrate-binding groove of a human PCSK9 selected from the group consisting of forms f, c, r, p, m, e, h, aj and q (see Cunningham et al., Nat Struct Mol Biol. 2007 May; 14(5): 413-9. Epub 2007 Apr. 15, "Structural and biophysical studies of PCSK9 and its mutants linked to familial hypercholesterolemia", incorporated herein in its entirety by reference). In an example, the ligand also specifically binds to the substrate-binding groove of form a and/or a'. In an embodiment, the ligand specifically binds to the Substrate-binding groove of form f PCSK9, wherein the epitope comprises at least one amino acid that is not found in form a. In an embodiment, the ligand specifically binds to the Substrate-binding groove of form c PCSK9, wherein the epitope comprises at least one amino acid that is not found in form a. In an embodiment, the ligand specifically binds to the Substrate-binding groove of form r PCSK9, wherein the epitope comprises at least one amino acid that is not found in form a. In an embodiment, the ligand specifically binds to the Substrate-binding groove of form p PCSK9, wherein the epitope comprises at least one amino acid that is not found in form a. In an embodiment, the ligand specifically binds to the Substrate-binding groove of form m PCSK9, wherein the epitope comprises at least one amino acid that is not found in form a. In an embodiment, the ligand specifically binds to the Substrate-binding groove of form e PCSK9, wherein the epitope comprises at least one amino acid that is not found in form a. In an embodiment, the ligand specifically binds to the Substrate-binding groove of form h PCSK9, wherein the epitope comprises at least one amino acid that is not found in form a. In an embodiment, the ligand specifically binds to the Substrate-binding groove of form aj PCSK9, wherein the epitope comprises at least one amino acid that is not found in form a. In an embodiment, the ligand specifically binds to the Substrate-binding groove of form q PCSK9, wherein the epitope comprises at least one amino acid that is not found in form a.

Reference is made to US20120093818A1 (Amgen, Inc), the entire disclosure of which is incorporated herein. This patent application discloses relevant ligands for use in the present invention, as well as examples and methods of producing and testing ligands that can be used with reference to the present invention.

In an example, the ligand is or comprises an antibody disclosed in Table 2 of US20120093818A1 (Amgen, Inc) or is a PCSK9-binding derivative thereof.

In an embodiment, the PCSK9-binding ligand of the invention is selected from the antigen binding proteins disclosed in US20120093818A1 (Amgen, Inc), eg, in paragraphs [0009] to and [0058] to [0063] of US20120093818A1; all of these disclosures (including the sequences of such proteins) are incorporated herein by reference as though explicitly recited herein and for possible inclusion in one or more claims or for use in the present invention.

In this paragraph SEQ ID NOs are those as appearing in US20120093818A1 (Amgen, Inc) and these sequences are incorporated herein by reference as though explicitly recited herein and for possible inclusion in one or more claims or for use in the present invention. In some aspects, the ligand of the invention comprises an isolated antigen binding protein that binds PCSK9 comprising: A) one or more heavy chain complementary determining regions (CDRHs) selected from the group consisting of: (i) a CDRH1 from a CDRH1 in a sequence selected from the group consisting of SEQ ID NO: 74, 85, 71, 72, 67, 87, 58, 52, 51, 53, 48, 54, 55, 56, 49, 57, 50, 91, 64, 62, 89, 65, 79, 80, 76, 77, 78, 83, 69, 81, and 60; (ii) a CDRH2 from a CDRH2 in a sequence selected from the group consisting of SEQ ID NO: 74, 85, 71, 72, 67, 87, 58, 52, 51, 53, 48, 54, 55, 56, 49, 57, 50, 91, 64, 62, 89, 65, 79, 80, 76, 77, 78, 83, 69, 81, and 60; (iii) a CDRH3 from a CDRH3 in a sequence selected from the group consisting of SEQ ID NO: 74, 85, 71, 72, 67, 87, 58, 52, 51, 53, 48, 54, 55, 56, 49, 57, 50, 91, 64, 62, 89, 65, 79, 80, 76, 77, 78, 83, 69, 81, and 60; and (iv) a CDRH of (i), (ii), and (iii) that contains one or more amino acid substitutions, deletions or insertions of no more than 4 amino acids; B) one or more light chain complementary determining regions (CDRLs) selected from the group consisting of: (i) a CDRL1 from a CDRL1 in a sequence selected from the group consisting of SEQ ID NO: 5, 7, 9, 10, 12, 13, 15, 16, 17, 18, 19, 20, 21, 22, 23, 24, 26, 28, 30, 31, 32, 33, 35, 36, 37, 38, 39, 40, 42, 44, and 46; (ii) a CDRL2 from a CDRL2 in a sequence selected from the group consisting of SEQ ID NO: 5, 7, 9, 10, 12, 13, 15, 16, 17, 18, 19, 20, 21, 22, 23, 24, 26, 28, 30, 31, 32, 33, 35, 36, 37, 38, 39, 40, 42, 44, and 46; (iii) a CDRL3 from a CDRL3 in a sequence selected from the group consisting of SEQ ID NO: 5, 7, 9, 10, 12, 13, 15, 16, 17, 18, 19, 20, 21, 22, 23, 24, 26, 28, 30, 31, 32, 33, 35, 36, 37, 38, 39, 40, 42, 44, and 46; and (iv) a CDRL of (i), (ii) and (iii) that contains one or more amino acid substitutions, deletions or insertions of no more than 4 amino acids; or C) one or more heavy chain CDRHs of A) and one or more light chain CDRLs of B). In some embodiments, the isolated antigen binding protein comprises at least one CDRH of A) and at least one CDRL of B). In some embodiments, the isolated antigen binding protein comprises at least two CDRH of A) and at least two CDRL of B). In some embodiments, the isolated antigen binding protein comprises said CDRH1, CDRH2, CDRH3, CDRL1, CDRL2 and CDRL3. In some embodiments, the CDRH of A) is selected from at least one of the group consisting of: (i) a CDRH1 amino acid sequence selected from the CDRH1 in a sequence selected from the group consisting of SEQ ID NO: 67, 79, 89, and 49; (ii) a CDRH2 amino acid sequence selected from the CDRH2 in a sequence selected from the group consisting of SEQ ID NO: 67, 79, 89, and 49; (iii) a CDRH3 amino acid sequence selected from the CDRH3 in a sequence selected from the group consisting of SEQ ID NO: 67, 79, 89, and 49; and (iv) a CDRH of (i), (ii) and (iii) that contains one or more amino acid substitutions, deletions or insertions of no more than 2 amino acids. In addition, the CDRL of B) is selected from at least one of the group consisting of: (i) a CDRL1 amino acid sequence selected from the CDRL1 in a sequence selected from the group consisting of SEQ ID NO: 12, 35, 32, and 23; (ii) a CDRL2 amino acid sequence selected from the CDRL2 in a sequence selected from the group consisting of SEQ ID NO: 12, 35, 32, and 23; (iii) a CDRL3 amino acid sequence selected from the CDRL3 in a sequence selected from the group consisting of SEQ ID NO: 12, 35, 32, and 23; and (iv) a CDRL of (i), (ii) and (iii) that contains one or more amino acid substitutions, deletions or insertions of no more than 2 amino acids; or C) one or more heavy chain CDRHs of A) and one or more light chain CDRLs of B. In some embodiments, the CDRH of A) is selected from at least one of the group consisting of: (i) a CDRH1 amino acid sequence of the CDRH1 amino acid sequence in SEQ ID NO: 67; (ii) a CDRH2 amino acid sequence of the CDRH2 amino acid sequence in SEQ ID NO: 67; (iii) a CDRH3 amino acid sequence of the CDRH3 amino acid sequence in SEQ ID NO: 67; and (iv) a CDRH of (i), (ii) and (iii) that contains one or more amino acid substitutions, deletions or insertions of no more than 2 amino acids; said CDRL of B) is selected from at least one of the group consisting of: (i) a CDRL1 amino acid sequence of the CDRL1 amino acid sequence in SEQ ID NO: 12; (ii) a CDRL2 amino acid sequence of the CDRL2 amino acid sequence in SEQ ID NO: 12; (iii) a CDRL3 amino acid sequence of the CDRL3 amino acid sequence in SEQ ID NO: 12; and (iv) a CDRL of (i), (ii) and (iii) that contains one or more amino acid substitutions, deletions or insertions of no more than 2 amino acids; or C) one or more heavy chain CDRHs of A) and one or more light chain CDRLs of B). In some embodiments, the antigen binding protein comprises A) a CDRH1 of the CDRH1 sequence in SEQ ID NO: 67, a CDRH2 of the CDRH2 sequence in SEQ ID NO: 67, and a CDRH3 of the CDRH3 sequence in SEQ ID NO: 67, and B) a CDRL1 of the CDRL1 sequence in SEQ ID NO: 12, a CDRL2 of the CDRL2 sequence in SEQ ID NO: 12, and a CDRL3 of the CDRL3 sequence in SEQ ID NO: 12. In some embodiments, the antigen binding protein comprises a heavy chain variable region (VH) having at least 80% sequence identity with an amino acid sequence selected from the group consisting of SEQ ID NO: 74, 85, 71, 72, 67, 87, 58, 52, 51, 53, 48, 54, 55, 56, 49, 57, 50, 91, 64, 62, 89, 65, 79, 80, 76, 77, 78, 83, 69, 81, and 60, and/or a light chain variable region (VL) having at least 80% sequence identity with an amino acid sequence selected from the group consisting of SEQ ID NO: 5, 7, 9, 10, 12, 13, 15, 16, 17, 18, 19, 20, 21, 22, 23, 24, 26, 28, 30, 31, 32, 33, 35, 36, 37, 38, 39, 40, 42, 44, and 46. In some embodiments, the VH has at least 90% sequence identity with an amino acid sequence selected from the group consisting of SEQ ID NO: 74, 85, 71, 72, 67, 87, 58, 52, 51, 53, 48, 54, 55, 56, 49, 57, 50, 91, 64, 62, 89, 65, 79, 80, 76, 77, 78, 83, 69, 81, and 60, and/or the VL has at least 90% sequence identity with an amino acid sequence selected from the group consisting of SEQ ID NO: 5, 7, 9, 10, 12, 13, 15, 16, 17, 18, 19, 20, 21, 22, 23, 24, 26, 28, 30, 31, 32, 33, 35, 36, 37, 38, 39, 40, 42, 44, and 46. In some embodiments, the VH is selected from the group consisting of SEQ ID NO: 74, 85, 71, 72, 67, 87, 58, 52, 51, 53, 48, 54, 55, 56, 49, 57, 50, 91, 64, 62, 89, 65, 79, 80, 76, 77, 78, 83, 69, 81, and 60, and/or the VL is selected from the group consisting of SEQ ID NO: 5, 7, 9, 10, 12, 13, 15, 16, 17, 18, 19, 20, 21, 22, 23, 24, 26, 28, 30, 31, 32, 33, 35, 36, 37, 38, 39, 40, 42, 44, and 46.

In an example of any aspect of the invention, the PCSK9-targeting or binding ligand comprises or consists of AMG145 or 31H4, 16F12, 11F1, 8A3 or 21B12 disclosed in US20120093818A1 (Amgen, Inc) or an antibody comprising the variable domains of AMG145, 31H4, 16F12, 11F1, 8A3 or 21B12, the disclosures of which (including sequences) are incorporated herein by reference as though explicitly recited herein and for possible inclusion in one or more claims or for use in the present invention. Preferably, the PCSK9-targeting or binding ligand comprises or consists of AMG145.

In an example, the AMG145 or other ligand of the invention is glycosylated, eg, has human glycosylation (eg, produced by a CHO, Cos or Hek293 cell). In an example, the ligand of the invention is produced in CHO.

Reference is made to US20110065902A1 (Regeneron Pharmaceuticals, Inc), the entire disclosure of which is incorporated herein. This patent application discloses relevant ligands for use in the present invention, as well as examples and methods of producing and testing ligands and determining medical efficacy that can be used with reference to the present invention.

Reference is made to the following PCT applications, the entire disclosures of which are incorporated herein. These disclose relevant ligands for use in the present invention, as well as examples and methods of producing and testing ligands and determining medical efficacy that can be used with reference to the present invention.

WO2008057457
WO2008057458
WO2008057459
WO2008063382
WO2008133647
WO2009100297
WO2009100318
WO2011037791
WO2011053759
WO2011053783
WO2008125623
WO2011072263
WO2009055783
WO2010029513
WO2011111007
WO2010077854

Antibody ligands to PCSK9 are described in, for example, WO 2008/057457, WO 2008/057458, WO 2008/057459, WO 2008/063382, WO 2008/125623, and US 2008/0008697; each of which is incorporated by reference herein in its entirety.

In an example, the ligand is or comprises an antibody disclosed in the Examples of US20110065902A1 (eg, 316P or 300N) or is a PCSK9-binding derivative thereof. All of these disclosures (including the sequences of such proteins and corresponding nucleotide sequences) are incorporated herein by reference as though explicitly recited herein and for possible inclusion in one or more claims or for use in the present invention. In an embodiment, the ligand is or comprises the variable domains of antibody 316P or 300N disclosed in US20110065902A1 or is (or comprises) such antibody or a PCSK9-binding derivative thereof.

In an embodiment, the ligand is or comprises the variable domains of antibody alirocumab or SAR236553/REGN727 (Sanofi Aventis/Regeneron) or is (or comprises) such antibody or a PCSK9-binding derivative thereof. In an example, the alirocumab is glycosylated, eg, has human glycosylation (eg, produced by a CHO, Cos or Hek293 cell). Preferably, the ligand is alirocumab or SAR236553/REGN727.

In an embodiment, the ligand is or comprises the variable domains of antibody evolocumab or is (or comprises) such antibody or a PCSK9-binding derivative thereof. In an example, the antibody is glycosylated, eg, has human glycosylation (eg, produced by a CHO, Cos or Hek293 cell). Preferably, the ligand is evolocumab.

In an embodiment, the ligand is selected from evolocumab, 1D05-IgG2 (Merck & Co.), ALN-PCS02 (Alnylam), RN316 (Pfizer-Rinat) and alirocumab.

In an embodiment, the ligand is selected from the following (sequences and definitions as per US2011/0065902, incorporated herein by reference):—

1. An antibody or antigen-binding fragment thereof which specifically binds hPCSK9, wherein the antibody or antigen-binding fragment comprises the heavy and light chain CDRs of a HCVR/LCVR amino acid sequence pair having SEQ ID NOs: 218/226.

2. The antibody or antigen-binding fragment of concept 1 comprising heavy and light chain CDR amino acid sequences having SEQ ID NOs: 220, 222, 224, 228, 230 and 232.

3. The antibody or antigen-binding fragment of concept 2 comprising an HCVR having the amino acid sequence of SEQ ID NO: 218 and an LCVR having the amino acid sequence of SEQ ID NO: 226.

4. An antibody or antigen-binding fragment thereof which binds to the same epitope on hPCSK9 as an antibody comprising heavy and light chain CDR amino acid sequences having SEQ ID NOs: 220, 222, 224, 228, 230 and 232.

5. An antibody or antigen-binding fragment thereof which competes for binding to hPCSK9 with an antibody comprising heavy and light chain CDR amino acid sequences having SEQ ID NOs: 220, 222, 224, 228, 230 and 232.

In an embodiment, the ligand is selected from the following (sequences and definitions as per US2012/0093818, incorporated herein by reference):—

1. An isolated neutralizing antigen binding protein that binds to a PCSK9 protein comprising the amino acid sequence of SEQ ID NO: 1, wherein the neutralizing antigen binding protein decreases the LDLR lowering effect of PCSK9 on LDLR, wherein the antigen binding protein comprises a light chain comprising an amino acid sequence of SEQ ID NO: 46, and wherein the antigen binding protein comprises a heavy chain comprising an amino acid sequence of SEQ ID NO: 60.

2. The isolated neutralizing antigen binding protein of concept 2, wherein the antigen binding protein is a LDLR non-competitive neutralizing antigen binding protein.

3. The isolated neutralizing antigen binding protein of concept 2, wherein the antigen binding protein is a LDLR competitive neutralizing antigen binding protein.

4. An antigen binding protein that selectively binds to PCSK9, wherein said antigen binding protein binds to PCSK9 with a Kd that is less than 100 pM.

5. An antigen binding protein that binds to a PCSK9 protein of SEQ ID NO: 303 in a first manner, wherein the antigen binding protein binds to a variant of PCSK9 in a second manner, wherein said PCSK9 variant has at least one point mutation at a position selected from the group consisting of: 207, 208, 185, 181, 439, 513, 538, 539, 132, 351, 390, 413, 582, 162, 164, 167, 123, 129, 311, 313, 337, 519, 521, and 554 of SEQ ID NO: 303, wherein the first manner comprises a first EC50, a first Bmax, or a first EC50 and a first Bmax, wherein the second manner comprises a second EC50, a second Bmax, or a second EC50 and a second Bmax, and wherein a value for the first manner is different from a value for the second manner, and wherein the antigen binding protein comprises a light chain comprising an amino acid sequence of SEQ ID NO: 46, and wherein the antigen binding protein comprises a heavy chain comprising an amino acid sequence of SEQ ID NO: 60.

6. The antigen binding protein of concept 6, wherein the first manner comprises a first Bmax, wherein the second manner comprises a second Bmax that is different from the first Bmax, and wherein said PCSK9 variant has at least one point mutation selected from the group consisting of: D162R, R164E, E167R, S123R, E129R, A311R, D313R, D337R, R519E, H521R, and Q554R.

7. The antigen binding protein of concept 6, wherein the antigen binding protein binds to PCSK9 at a location that overlaps with a location that LDLR binds to PCSK9.

8. A method of making an antigen binding protein that binds to a PCSK9 protein comprising the amino acid sequence of SEQ ID NO: 1, wherein the antigen binding protein decreases the LDLR lowering effect of PCSK9 on LDLR, said method comprising: providing a host cell comprising a nucleic acid sequence that encodes the antigen binding protein; and maintaining the host cell under conditions in which the antigen binding protein is expressed, wherein the antigen binding protein comprises a light chain comprising an amino acid sequence of SEQ ID NO: 46, and wherein the antigen binding protein comprises a heavy chain comprising an amino acid sequence of SEQ ID NO: 60.

9. A method for treating or preventing a condition associated with elevated serum cholesterol levels in a subject, said method comprising administering to a subject in need thereof an effective amount of an isolated neutralizing antigen binding protein simultaneously or sequentially with an agent that elevates the availability of LDLR protein, wherein the isolated antigen binding protein binds to a PCSK9 protein comprising the amino acid sequence of SEQ ID NO: 1, wherein the neutralizing antigen binding protein decreases the LDLR lowering effect of PCSK9 on LDLR, wherein the antigen binding protein comprises a light chain comprising an amino acid sequence of SEQ ID NO: 46, and wherein the antigen binding protein comprises a heavy chain comprising an amino acid sequence of SEQ ID NO: 60.

10. The method of concept 10, wherein the agent that elevates the availability of LDLR protein comprises a statin.

11. An antigen binding protein that binds to PCSK9, wherein when the antigen binding protein is bound to PCSK9, the antibody is positioned 8 angstroms or less from at least one of the following residues of PCSK9: S153, S188, I189, Q190, S191, D192, R194, E197, G198, R199, V200, D224, R237, D238, K243, S373, D374, S376, T377, F379, I154, T187, H193, E195, I196, M201, V202, C223, T228, S235, G236, A239, G244, M247, I369, S372, C375, or C378, wherein the antigen binding protein comprises a light chain comprising an amino acid sequence of SEQ ID NO: 46, and wherein the antigen binding protein comprises a heavy chain comprising an amino acid sequence of SEQ ID NO: 60.

The ligand can be used for the treatment, therapy, prophylaxis and/or diagnosis of one or more diseases or conditions or susceptibility thereto, wherein such diseases or conditions comprise those disclosed in US20120093818A1 (Amgen, Inc) and US20110065902A1 (Regeneron Pharmaceuticals, Inc), eg, a disease or condition disclosed in paragraphs [0375] to [0383] of US20120093818A1, which disclosure is incorporated herein by reference in its entirety for inclusion in one more claims herein.

The ligand can be administered to a human characterised as described in US20120093818A1 (Amgen, Inc) or US20110065902A1.

The ligand can be administered in a form or combination disclosed in US20120093818A1 (Amgen, Inc) or US20110065902A1, which disclosure is incorporated herein by reference. For example, the ligand with a drug, excipient, diluent or carrier as described in US20120093818A1 (Amgen, Inc) or US20110065902A1 (eg, as disclose in paragraphs [0384] to [0412] of US20120093818A1), which disclosure is incorporated herein by reference, and the present invention also relates to the corresponding pharmaceutical compositions comprising the combination of a ligand of the invention and such a further agent.

The ligand can be used in a method of diagnosis as set out in US20120093818A1 (Amgen, Inc) or US20110065902A1, eg, in paragraphs [0413] to [0415] of US20120093818A1 which disclosure is incorporated herein by reference.

Diagnostic Applications

In some embodiments, the ligand of the invention is a diagnostic tool. The ligand can be used to assay the amount of PCSK9 present in a sample and/or subject. As will be appreciated by one of skill in the art, such ligands need not be neutralizing ligands. In some embodiments, the diagnostic ligand is not a neutralizing ligand. In some embodiments, the diagnostic ligand binds to a different epitope than a neutralizing ligand binds to. In some embodiments, the two ligands do not compete with one another.

In some embodiments, the ligands of the invention are used or provided in an assay kit and/or method for the detection of PCSK9 in mammalian tissues or cells in order to screen/diagnose for a disease or disorder associated with changes in levels of PCSK9. The kit comprises a ligand that binds PCSK9 and means for indicating the binding of the ligand with PCSK9, if present, and optionally PCSK9 protein levels. Various means for indicating the presence of a ligand can be used. For example, fluorophores, other molecular probes, or enzymes can be linked to the ligand and the presence of the ligand can be observed in a variety of ways. The method for screening for such disorders can involve the use of the kit, or simply the use of one of the disclosed ligands and the determination of whether the ligand binds to PCSK9 in a sample. As will be appreciated by one of skill in the art, high or elevated levels of PCSK9 will result in larger amounts of the ligand binding to PCSK9 in the sample. Thus, degree of ligand binding can be used to determine how much PCSK9 is in a sample. Subjects or samples with an amount of PCSK9 that is greater than a predetermined amount (e.g., an amount or range that a person without a PCSK9 related disorder would have) can be characterized as having a PCSK9 mediated disorder. In some embodiments, the invention provides a method wherein the ligand is administered to a subject taking a statin, in order to determine if the statin has increased the amount of PCSK9 in the subject.

In some embodiments, the ligand is a non-neutralizing ligand and is used to determine the amount of PCSK9 in a subject receiving an ABP and/or statin treatment.

In some embodiments, the ligand of the invention can specifically bind human PCSK9 (eg, one, two or more rare variant forms disclosed herein) and is characterized by at least one of: (i) capable of reducing serum total cholesterol at least about 25-35% and sustaining the reduction over at least a 24 day period relative to a predose level; (ii) capable of reducing serum LDL cholesterol at least about 65-80% and sustaining the reduction over at least a 24 day period relative to a predose level; (iii) capable of reducing serum LDL cholesterol at least about 40-70% and sustaining the reduction over at least a 60 or 90 day period relative to a predose level; (iv) capable of reducing serum triglyceride at least about 25-40% relative to predose level; (v) does not reduce serum HDL cholesterol or reduces serum HDL cholesterol no more than 5% relative to predose level. In some embodiments, an isolated nucleic acid molecule is provided and it encodes the ligand. In some embodiments an expression vector is provided and comprises the nucleic acid molecule. In some embodiments, a pharmaceutical composition is provided and it can comprise the ligand and a pharmaceutically acceptable carrier. In some embodiments, a method is provided for treating a disease or condition which is ameliorated, improved, inhibited or prevented with a PCSK9 antagonist ligand of the invention. The method can comprise administering a therapeutic amount of the pharmaceutical composition or ligand to a subject in need thereof. In some embodiments, the subject is a human subject suffering from hypercholesterolemia, hyperlipidemia, indicated for LDL apheresis, identified as heterozygous for Familial Hypercholesterolemia, statin intolerant, statin uncontrolled, at risk for developing hypercholesterolemia, dyslipidemia, cholestatic liver disease, nephrotic syndrome, hypothyroidism, obesity, atherosclerosis and cardiovascular diseases. In some embodiments, a method of providing a treatment or therapy is provided to a subject. In some embodiments, the method comprises reducing serum cholesterol at least about 40-70% over at least 60 to 90 days. In some embodiments, a method of receiving treatment or therapy is provided, the method can comprise receiving a ligand thereof at a frequency of once every 60 to 90 days.

In one aspect, the invention provides a ligand of the invention which is or comprises an human antibody or antigen-binding fragment of a human antibody that specifically binds and inhibits human proprotein convertase subtilisin/kexin type 9 (hPCSK9, eg, one, two or more rare variant forms disclosed herein and optionally form a and/or form a'), characterized by the ability to reduce serum LDL cholesterol in a human by 40-80% over a 24, 60 or 90 day period relative to predose levels, with little or no reduction in serum HDL cholesterol and/or with little or no measurable effect on liver function, as determined by ALT and AST measurements.

In one embodiment, the ligand of the invention comprises an antibody or antigen-binding fragment of an antibody that specifically binds hPCSK9 and is characterized by at least one of:

(i) capable of reducing serum total cholesterol at least about 25-35% and sustaining the reduction over at least a 24 day period relative to a predose level, preferably the reduction in serum total cholesterol is at least about 30-40%;

(ii) capable of reducing serum LDL cholesterol at least about 65-80% and sustaining the reduction over at least a 24 day period relative to a predose level;

(iii) capable of reducing serum triglyceride at least about 25-40% relative to predose level;

(iv) does not reduce serum HDL cholesterol or reduces serum HDL cholesterol no more than 5% relative to predose level.

See US2011/0065902 for definitions of these terms and optional features, the disclosure of which is incorporated herein by reference in its entirety.

In one embodiment, the invention comprises an antibody or antigen-binding fragment of an antibody that specifically binds hPCSK9 and is characterized by at least one of:

(i) capable of reducing serum LDL cholesterol at least about 40-70% and sustaining the reduction over at least a 60 or 90 day period relative to a predose level;

(ii) capable of reducing serum triglyceride at least about 25-40% relative to predose level;

(iii) does not reduce serum HDL cholesterol or reduces serum HDL cholesterol no more than 5% relative to predose level.

In one embodiment, the antibody or antigen-binding fragment is characterized as exhibiting an enhanced binding affinity (KD) for hPCSK9 at pH 5.5 relative to the KD at pH 7.4, as measured by plasmon surface resonance. In a specific embodiment, the antibody or fragment thereof exhibits at least a 20-fold, at least a 40-fold or at least a 50-fold enhanced affinity for PCSK9 at an acidic pH relative to a neutral pH, as measured by surface plasmon resonance.

In one embodiment, the antibody or antigen-binding fragment is characterized as not exhibiting an enhanced binding affinity for PCSK9 at an acidic pH relative to a neutral pH, as measured by surface plasmon resonance. In a specific embodiment, the antibody or fragment thereof exhibits a decreased binding affinity at an acidic pH.

In another embodiment, the antibody or antigen-binding fragment binds human, human GOF mutation D374Y, cynomolgus monkey, rhesus monkey, mouse, rat and hamster PCSK9.

In one embodiment, the antibody or antigen-binding fragment binds human and monkey PCSK9, but does not bind mouse, rat or hamster PCSK9.

In one embodiment, the invention comprises an antibody or antigen-binding fragment of an antibody comprising one or more of a heavy chain variable region (HCVR), light chain variable region (LCVR), HCDR1, HCDR2, HCDR3 disclosed in any of paragraphs [023]-[037] of US2011/0065902, the disclosures of which are incorporated herein by reference.

In a related embodiment, the invention comprises an antibody or antigen-binding fragment of an antibody which specifically binds hPCSK9, wherein the antibody or fragment comprises heavy and light chain CDR domains contained within heavy and light chain sequence pairs selected from the group consisting of SEQ ID NO (using the sequence numbering in US2011/0065902): 2/10, 18/20, 22/24, 26/34, 42/44, 46/48, 50/58, 66/68, 70/72, 74/82, 90/92, 94/96, 98/106, 114/116, 118/120, 122/130, 138/140, 142/144, 146/154, 162/164, 166/168, 170/178, 186/188, 190/192, 194/202, 210/212, 214/216, 218/226, 234/236, 238/240, 242/250, 258/260, 262/264, 266/274, 282/284, 286/288, 290/298, 306/308, 310/312, 314/322, 330/332, 334/336, 338/346, 354/356, 358/360, 362/370, 378/380, 382/384, 386/394, 402/404, 406/408, 410/418, 426/428, 430/432, 434/442, 450/452, 454/456, 458/466, 474/476, 478/480, 482/490, 498/500, 502/504, 506/514, 522/524, 526/528, 530/538, 546/548, 550/552, 554/562, 570/572, 574/576, 578/586, 594/596, 598/600, 602/610, 618/620, 622/624, 626/634, 642/644, 646/648, 650/658, 666/668, 670/672, 674/682, 690/692, 694/696, 698/706, 714/716, 718/720, 722/730, 738/740 and 742/744. In one embodiment, the CDR sequences are contained within HCVR and LCVR selected from the amino acid sequence pairs of SEQ ID NO: 50/58, 66/68, 70/72, 74/82, 90/92, 94/96, 122/130, 138/140, 142/144, 218/226, 234/236, 238/240, 242/250, 258/260, 262/264, 314/322, 330/332 and 334/336. In more specific embodiments, the CDR sequences are comprised within HCVR/LCVR sequences selected from SEQ ID NO: 90/92 or 218/226.

In an example, the invention features a pharmaceutical composition comprising a ligand of the invention, wherein the ligand comprises or consists of a recombinant human antibody or fragment thereof which specifically binds hPCSK9 and a pharmaceutically acceptable carrier. In one embodiment, the invention features a composition which is a combination of a ligand of the invention (eg, an antibody or antigen-binding fragment of an antibody), and a second therapeutic agent. The second therapeutic agent may be any agent that is advantageously combined with the ligand of the invention, for example, an agent capable of inducing a cellular depletion of cholesterol synthesis by inhibiting 3-hydroxy-3-methylglutaryl (HMG)-coenzyme A (CoA) reductase, such as, for example, cerovastatin, atorvastatin, simvastatin, pitavastin, rosuvastatin, fluvastatin, lovastatin, pravastatin, etc; capable of inhibiting cholesterol uptake and or bile acid re-absorption; capable of increasing lipoprotein catabolism (such as niacin); and/or activators of the LXR transcription factor that plays a role in cholesterol elimination such as 22-hydroxycholesterol.

In an example, the invention provides a method for inhibiting hPCSK9 activity using the anti-PCSK9 ligand of the invention (eg, an antibody or antigen-binding portion of the antibody of the invention), wherein the therapeutic methods comprise administering a therapeutically effective amount of a pharmaceutical composition comprising an antibody or antigen-binding fragment of an antibody of the invention. The disorder treated is any disease or condition which is improved, ameliorated, inhibited or prevented by removal, inhibition or reduction of PCSK9 activity. Specific populations treatable by the therapeutic methods of the invention include subjects indicated for LDL apheresis, subjects with PCSK9-activating mutations (gain of function mutations, "GOF"), subjects with heterozygous Familial Hypercholesterolemia (heFH); subjects with primary hypercholesterolemia who are statin intolerant or statin uncontrolled; and subjects at risk for developing hypercholesterolemia who may be preventably treated. Other indications include dyslipidemia associated with secondary causes such as Type 2 diabetes mellitus, cholestatic liver diseases (primary biliary cirrhosis), nephrotic syndrome, hypothyroidism, obesity; and the prevention and treatment of atherosclerosis and cardiovascular diseases.

In specific embodiments of the method of the invention, the ligand of the invention (eg, anti-hPCSK9 antibody or antibody fragment of the invention) is useful to reduce elevated total cholesterol, non-HDL cholesterol, LDL cholesterol, and/or apolipoprotein B (apolipoprotein B100).

The ligand (eg, antibody or antigen-binding fragment) of the invention may be used alone or in combination with a second agent, for example, an HMG-CoA reductase inhibitor and/or another lipid lowering drug.

Treatment Population

The invention provides therapeutic methods for treating a human patient in need of a composition or ligand of the invention. While modifications in lifestyle and conventional drug treatment are often successful in reducing cholesterol levels, not all patients are able to achieve the recommended target cholesterol levels with such approaches. Various conditions, such as familial hypercholesterolemia (FH), appear to be resistant to lowering of LDL-C levels in spite of aggressive use of conventional therapy. Homozygous and heterozygous familial hypercholesterolemia (hoFH, heFH) is a condition associated with premature atherosclerotic vascular disease. However, patients diagnosed with hoFH are largely unresponsive to conventional drug therapy and have limited treatment options. Specifically, treatment with statins, which reduce LDL-C by inhibiting cholesterol synthesis and upregulating the hepatic LDL receptor, may have little effect in patients whose LDL receptors are non-existent or defective. A mean LDL-C reduction of only less than about 20% has been recently reported in patients with genotype-confirmed hoFH treated with the maximal dose of statins. The addition of ezetimibe 10 mg/day to this regimen resulted in a total reduction of LDL-C levels of 27%, which is still far from optimal. Likewise, many patients are statin non-responsive, poorly controlled with statin therapy, or cannot tolerate statin therapy; in general, these patients are unable to achieve cholesterol control with alternative treatments. There is a large unmet medical need for new treatments that can address the short-comings of current treatment options.

Specific populations treatable by the therapeutic methods of the invention include patients indicated for LDL apheresis, subjects with PCSK9-activating (GOF) mutations, heterozygous Familial Hypercholesterolemia (heFH); subjects with primary hypercholesterolemia who are statin intolerant or statin uncontrolled; and subjects at risk for developing hypercholesterolemia who may be preventably treated.

Therapeutic Administration and Formulations

The invention provides therapeutic compositions comprising the anti-PCSK9 ligands, antibodies or antigen-binding fragments thereof of the present invention. The administration of therapeutic compositions in accordance with the invention will be administered with suitable carriers, excipients, and other agents that are incorporated into formulations to provide improved transfer, delivery, tolerance, and the like. A multitude of appropriate formulations can be found in the formulary known to all pharmaceutical chemists: Remington's Pharmaceutical Sciences, Mack Publishing Company, Easton, Pa. These formulations include, for example, powders, pastes, ointments, jellies, waxes, oils, lipids, lipid (cationic or anionic) containing vesicles (such as LIPOFECTIN™), DNA conjugates, anhydrous absorption pastes, oil-in-water and water-in-oil emulsions, emulsions carbowax (polyethylene glycols of various molecular weights), semi-solid gels, and semi-solid mixtures containing carbowax. See also Powell et al. "Compendium of excipients for parenteral formulations" PDA (1998) J Pharm Sci Technol 52:238-311.

The dose may vary depending upon the age and the size of a subject to be administered, target disease, conditions, route of administration, and the like. When the ligand, eg, antibody, of the present invention is used for treating various conditions and diseases associated with PCSK9, including hypercholesterolemia, disorders associated with LDL and apolipoprotein B, and lipid metabolism disorders, and the like, in an adult patient, it is advantageous to intravenously administer the ligand or antibody of the present invention normally at a single dose of about 0.01 to about 20 mg/kg body weight, more preferably about 0.02 to about 7, about 0.03 to about 5, or about 0.05 to about 3 mg/kg body weight. Depending on the severity of the condition, the frequency and the duration of the treatment can be adjusted.

Various delivery systems are known and can be used to administer the pharmaceutical composition of the invention, thus the composition invention provides the ligand by e.g., encapsulation in liposomes, microparticles, microcapsules, recombinant cells capable of expressing the mutant viruses, receptor mediated endocytosis (see, e.g., Wu et al. (1987) J. Biol. Chem. 262:4429-4432). Methods of introduction include, but are not limited to, intradermal, intramuscular, intraperitoneal, intravenous, subcutaneous, intranasal, epidural, and oral routes. The composition may be administered by any convenient route, for example by infusion or bolus injection, by absorption through epithelial or mucocutaneous linings (e.g., oral mucosa, rectal and intestinal mucosa, etc.) and may be administered together with other biologically active agents. Administration can be systemic or local.

The pharmaceutical composition can be also delivered in a vesicle, in particular a liposome (see Langer (1990) Science 249:1527-1533; Treat et al. (1989) in Liposomes in the Therapy of Infectious Disease and Cancer, Lopez Berestein and Fidler (eds.), Liss, New York, pp. 353-365; Lopez-Berestein, ibid., pp. 317-327; see generally ibid.).

In certain situations, the pharmaceutical composition can be delivered in a controlled release system. In one embodiment, a pump may be used (see Langer, supra; Sefton (1987) CRC Crit. Ref. Biomed. Eng. 14:201). In another embodiment, polymeric materials can be used; see, Medical Applications of Controlled Release, Langer and Wise (eds.), CRC Pres., Boca Raton, Fla. (1974). In yet another embodiment, a controlled release system can be placed in proximity of the composition's target, thus requiring only a fraction of the systemic dose (see, e.g., Goodson, in Medical Applications of Controlled Release, supra, vol. 2, pp. 115-138, 1984).

The injectable preparations may include dosage forms for intravenous, subcutaneous, intracutaneous and intramuscular injections, drip infusions, etc. These injectable preparations may be prepared by methods publicly known. For example, the injectable preparations may be prepared, e.g., by dissolving, suspending or emulsifying the antibody or its salt described above in a sterile aqueous medium or an oily medium conventionally used for injections. As the aqueous medium for injections, there are, for example, physiological saline, an isotonic solution containing glucose and other auxiliary agents, etc., which may be used in combination with an appropriate solubilizing agent such as an alcohol (e.g., ethanol), a polyalcohol (e.g., propylene glycol, polyethylene glycol), a nonionic surfactant [e.g., polysorbate 80, HCO-50 (polyoxyethylene (50 mol) adduct of hydrogenated castor oil)], etc. As the oily medium, there are employed, e.g., sesame oil, soybean oil, etc., which may be used in combination with a solubilizing agent such as benzyl benzoate, benzyl alcohol, etc. The injection thus prepared is preferably filled in an appropriate ampoule. A pharmaceutical composition of the present invention can be delivered subcutaneously or intravenously with a standard needle and syringe. In addition, with respect to subcutaneous delivery, a pen delivery device readily has applications in delivering a pharmaceutical composition of the present invention. Such a pen delivery device can be reusable or disposable. A reusable pen delivery device generally utilizes a replaceable cartridge that contains a pharmaceutical composition. Once all of the pharmaceutical composition within the cartridge has been administered and the cartridge is empty, the empty cartridge can readily be discarded and replaced with a new cartridge that contains the pharmaceutical composition. The pen delivery device can then be reused. In a disposable pen delivery device, there is no replaceable cartridge. Rather, the disposable pen delivery device comes prefilled with the pharmaceutical composition held in a reservoir within the device. Once the reservoir is emptied of the pharmaceutical composition, the entire device is discarded.

Numerous reusable pen and autoinjector delivery devices have applications in the subcutaneous delivery of a pharmaceutical composition of the present invention. Examples include, but certainly are not limited to AUTOPEN™ (Owen Mumford, Inc., Woodstock, UK), DISETRONIC™ pen (Disetronic Medical Systems, Burghdorf, Switzerland), HUMALOG MIX 75/25™ pen, HUMALOG™ pen, HUMALIN 70/30™ pen (Eli Lilly and Co., Indianapolis, Ind.), NOVOPEN™I, II and III (Novo Nordisk, Copenhagen, Denmark), NOVOPEN JUNIOR™ (Novo Nordisk, Copenhagen, Denmark), BD™ pen (Becton Dickinson, Franklin Lakes, N.J.), OPTIPENT™, OPTIPEN PRO™, OPTIPEN STARLET™, and OPTICLIKT™ (sanofi-aventis, Frankfurt, Germany), to name only a few. Examples of disposable pen delivery devices having applications in subcutaneous delivery of a pharmaceutical composition of the present invention include, but certainly are not limited to the SOLOSTAR™ pen (sanofi-aventis), the FLEXPEN™ (Novo Nordisk), and the KWIKPEN™ (Eli Lilly).

Advantageously, the pharmaceutical compositions for oral or parenteral use described above are prepared into dosage forms in a unit dose suited to fit a dose of the active ingredients. Such dosage forms in a unit dose include, for example, tablets, pills, capsules, injections (ampoules), suppositories, etc. The amount of the aforesaid antibody contained is generally about 5 to about 500 mg per dosage form in a unit dose; especially in the form of injection, it is preferred that the aforesaid antibody is contained in about 5 to about 100 mg and in about 10 to about 250 mg for the other dosage forms.

The invention provides therapeutic methods in which the ligand, eg, antibody or antibody fragment, of the invention is useful to treat hypercholesterolemia associated with a variety of conditions involving hPCSK9. The anti-PCSK9 ligands, eg, antibodies or antibody fragments, of the invention are particularly useful for the treatment of hypercholesterolemia and the like. Combination therapies may include the anti-PCSK9 ligand of the invention with, for example, one or more of any agent that (1) induces a cellular depletion of cholesterol synthesis by inhibiting 3-hydroxy-3-methylglutaryl (HMG)-coenzyme A (CoA) reductase, such as cerivastatin, atorvastatin, simvastatin, pitavastatin, rosuvastatin, fluvastatin, lovastatin, pravastatin; (2) inhibits cholesterol uptake and or bile acid re-absorption; (3) increase lipoprotein catabolism (such as niacin); and activators of the LXR transcription factor that plays a role in cholesterol elimination such as 22-hydroxycholesterol or fixed combinations such as ezetimibe plus simvastatin; a statin with a bile resin (e.g., cholestyramine, colestipol, colesevelam), a fixed combination of niacin plus a statin (e.g., niacin with lovastatin); or with other lipid lowering agents such as omega-3-fatty acid ethyl esters (for example, omacor).

Tailoring Antibodies to Rare PCSK9 Variant Profile

As outline above, the invention includes the possibility to tailor treatment of humans further by selecting antibody-based ligands with variable domains based on gene segments commonly found in humans of the ethnic populations where the variant PCSK9 forms are found to meet the selection criteria of the invention. An example is provided below for ligands comprising antibody VH domains derived from recombination of human VH3-23.

The inventor analysed the frequencies and distribution of various human VH3-23 alleles and realised the desirability of using ligands based on human VH3-23 alleles comprising SNP rs56069819. This SNP corresponds to a change from leucine at position 24 in the encoded protein sequence to a valine at that position (L24V change) and the SNP is at coordinate 106268889 on human chromosome 14.

Figure 2:
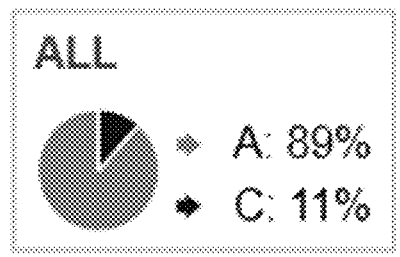
FIG. 2 depicts the cumulative allele frequency distribution across the 1000 Genomes Project database of human VH3-23 alleles comprising SNP rs56069819 (such alleles denoted "C" and the most frequent allele (which does not comprise this SNP) denoted "A"). The figure shows that VH3-23 alleles comprising SNP rs56069819 are present at a cumulative frequency of 11% across all human ethnic populations taken as a whole, whereas in certain specific human ethnic sub-populations (ASW, LWK, YRI, CEU and GBR) such alleles are present at an above-average cumulative frequency. Indicated in the figure are those human PCSK9 variant forms (marked "Variants") that are found in the various sub-populations with above-average occurrence of human VH3-23 alleles comprising SNP rs56069819.
Figure 2:
Figure 2:
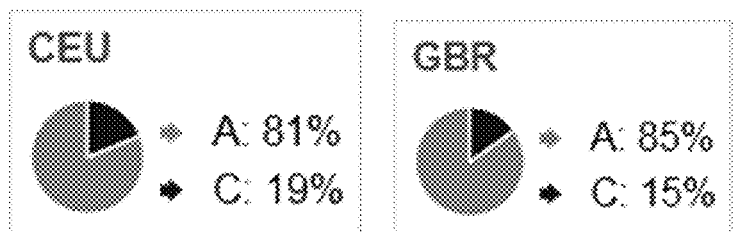

FIG. 2 shows the cumulative allele frequency distribution across the 1000 Genomes Project database of human VH3-23 alleles comprising SNP rs56069819 (such alleles denonted "C" and the most frequent allele (which does not comprise this SNP) denoted "A"). The figure shows that VH3-23 alleles comprising SNP rs56069819 are present at a cumulative frequency of 11% across all human ethnic populations taken as a whole, whereas in certain specific human ethnic sub-populations (ASW, LWK, YRI, CEU and GBR) such alleles are present at an above-average cumulative frequency. Indicated in the figure are those human PCSK9 variant forms (marked "Variants") that are found in the various sub-populations with above-average occurrence of human VH3-23 alleles comprising SNP rs56069819. Table 7 shows the VH3-23 variants and the SNPs that they comprise, as well as their cumulative allele frequencies as found in the 1000 Genomes Project database.

Notably, human VH3-23 alleles comprising SNP rs56069819 were found in the CEU population at a frequency that is almost double the frequency of 11% for all populations. For the ASW and YRI populations the frequency was over a quarter of the population. Thus, the invention advantageously enables one to select a ligand comprising an antibody or antibody fragment, wherein the antibody or fragment comprises a VH domain derived from the recombination of a human VH gene segment, a human D gene segment and a human JH gene segment, the VH gene segment comprising a nucleotide sequence that comprises SNP rs56069819 (db-SNP numbering, build number as recited above).

In an example, one can tailor the treatment further by selecting such a ligand that specifically binds to a human PCSK9 selected from forms: f, c, m, e, h, p, q and aj, such forms being those appearing in human populations ASW, LWK, YRI, CEU and GBR.

In an example, the ligand specifically binds to a human PCSK9 comprising a mutation I474V in SEQ ID NO: 1, wherein the human is of ASW, LWK, YRI, CEU or GBR ancestry. Optionally, the human comprises gene segment VH3-23*04 and/or a nucleotide sequence encoding said PCSK9 comprising a mutation I474V in SEQ ID NO: 1. In an example, additionally the ligand is an antibody or fragment comprising a VH domain derived from the recombination of human gene segment VH3-23*04.

In an example, the ligand specifically binds to a human PCSK9 comprising a mutation I474V in SEQ ID NO: 1 (eg, form f, r, p, e or aj), wherein the human is of ASW, LWK, YRI, CEU or GBR ancestry. Optionally, the human comprises gene segment VH3-23*04 and/or a nucleotide sequence encoding said PCSK9 comprising a mutation I474V in SEQ ID NO: 1. In an example, additionally the ligand is an antibody or fragment comprising a VH domain derived from the recombination of human gene segment VH3-23*04. Optionally, the ligand is for treating or preventing dislipidemia in said human, eg, for reducing cholesterol or maintaining a previously reduced cholesterol level in said human.

In an example, the ligand specifically binds to a human PCSK9 comprising a mutation E670G in SEQ ID NO: 1 (eg, form c, r or q), wherein the human is of ASW, LWK, YRI, CEU or GBR ancestry. Optionally, the human comprises gene segment VH3-23*04 and/or a nucleotide sequence encoding said PCSK9 comprising a mutation I474V in SEQ ID NO: 1. In an example, additionally the ligand is an antibody or fragment comprising a VH domain derived from the recombination of human gene segment VH3-23*04. Optionally, the ligand is for treating or preventing dislipidemia in said human, eg, for reducing cholesterol or maintaining a previously reduced cholesterol level in said human.

In an example, the ligand specifically binds to a human PCSK9 comprising a mutation Q619P in SEQ ID NO: 1 (eg, form h), wherein the human is of ASW, LWK, YRI, CEU or GBR ancestry. Optionally, the human comprises gene segment VH3-23*04 and/or a nucleotide sequence encoding said PCSK9 comprising a mutation I474V in SEQ ID NO: 1. In an example, additionally the ligand is an antibody or fragment comprising a VH domain derived from the recombination of human gene segment VH3-23*04. Optionally, the ligand is for treating or preventing dislipidemia in said human, eg, for reducing cholesterol or maintaining a previously reduced cholesterol level in said human.

In an example, the ligand specifically binds to a human PCSK9 comprising a mutation N425S in SEQ ID NO: 1 (eg, form e), wherein the human is of ASW, LWK, YRI, CEU or GBR ancestry. Optionally, the human comprises gene segment VH3-23*04 and/or a nucleotide sequence encoding said PCSK9 comprising a mutation I474V in SEQ ID NO: 1. In an example, additionally the ligand is an antibody or fragment comprising a VH domain derived from the recombination of human gene segment VH3-23*04. Optionally, the ligand is for treating or preventing dislipidemia in said human, eg, for reducing cholesterol or maintaining a previously reduced cholesterol level in said human.

In an example, the ligand specifically binds to a human PCSK9 comprising a mutation R46L in SEQ ID NO: 1 (eg, form aj), wherein the human is of ASW, LWK, YRI, CEU or GBR ancestry. Optionally, the human comprises gene segment VH3-23*04 and/or a nucleotide sequence encoding said PCSK9 comprising a mutation I474V in SEQ ID NO: 1. In an example, additionally the ligand is an antibody or fragment comprising a VH domain derived from the recombination of human gene segment VH3-23*04. Optionally, the ligand is for treating or preventing dislipidemia in said human, eg, for increasing cholesterol level in said human.

In an example, the ligand specifically binds to a human PCSK9 comprising a mutation A53V in SEQ ID NO: 1 (eg, form p or q), wherein the human is of ASW, LWK, YRI, CEU or GBR ancestry. Optionally, the human comprises gene segment VH3-23*04 and/or a nucleotide sequence encoding said PCSK9 comprising a mutation I474V in SEQ ID NO: 1. In an example, additionally the ligand is an antibody or fragment comprising a VH domain derived from the recombination of human gene segment VH3-23*04. Optionally, the ligand is for treating or preventing dislipidemia in said human, eg, for increasing cholesterol level in said human.

In an example, the ligand specifically binds to a human PCSK9 comprising a mutation A443T in SEQ ID NO: 1 (eg, form m or h), wherein the human is of ASW, LWK, YRI, CEU or GBR ancestry. Optionally, the human comprises gene segment VH3-23*04 and/or a nucleotide sequence encoding said PCSK9 comprising a mutation I474V in SEQ ID NO: 1. In an example, additionally the ligand is an antibody or fragment comprising a VH domain derived from the recombination of human gene segment VH3-23*04. Optionally, the ligand is for treating or preventing dislipidemia in said human, eg, for increasing cholesterol level in said human.

In an example, the VH gene segment is VH3-23*04, which is a commonly found variant that comprises SNP rs56069819 in human populations ASW, LWK, YRI, CEU and GBR.

In an example, the ligand is for treating and/or preventing a PCSK9-mediated disease or condition in a human that expresses a human PCSK9 selected from forms: f c, m, e, h, p, q and aj.

In an example, the ligand is for treating and/or preventing a PCSK9-mediated disease or condition in a human of ASW, LWK, YRI, CEU or GBR ancestry.

In an embodiment, the ligand is for treating and/or preventing a PCSK9-mediated disease or condition in a human of ASW ancestry, wherein the human expresses a PCSK9 selected from f c, m, e, h, p and q or the human comprises a corresponding nucleotide or amino acid sequence as set out in Table 6. Optionally this ligand comprises a VH domain derived from recombination of human VH3-23*04.

In an embodiment, the ligand is for treating and/or preventing a PCSK9-mediated disease or condition in a human of LWK ancestry, wherein the human expresses a PCSK9 selected from f c, m, e and h or the human comprises a corresponding nucleotide or amino acid sequence as set out in Table 6. Optionally this ligand comprises a VH domain derived from recombination of human VH3-23*04.

In an embodiment, the ligand is for treating and/or preventing a PCSK9-mediated disease or condition in a human of YRI ancestry, wherein the human expresses a PCSK9 selected from f c, m, e and h or the human comprises a corresponding nucleotide or amino acid sequence as set out in Table 6. Optionally this ligand comprises a VH domain derived from recombination of human VH3-23*04.

In an embodiment, the ligand is for treating and/or preventing a PCSK9-mediated disease or condition in a human of CEU ancestry, wherein the human expresses a PCSK9 selected from f, c, p and aj or the human comprises a corresponding nucleotide or amino acid sequence as set out in Table 6. Optionally this ligand comprises a VH domain derived from recombination of human VH3-23*04.

In an embodiment, the ligand is for treating and/or preventing a PCSK9-mediated disease or condition in a human of GBR ancestry, wherein the human expresses a PCSK9 selected from f, c and p or the human comprises a corresponding nucleotide or amino acid sequence as set out in Table 6.

Optionally this ligand comprises a VH domain derived from recombination of human VH3-23*04.

In an example, the ligand is alirocumab.

In other embodiments of any configuration or TOI herein, as explained more fully above, the invention provides for ligands which are tailored to the human recipient's genotype and/or phenotype based on alternative human VH gene segments, or on Vκ, Vλ or constant region gene segments (see further Table 9 for representative variants).

For example, the ligand of the invention comprises or consists of an antibody that comprises a VH domain that is derived from the recombination of a human VH gene segment, a human D gene segment and a human JH gene segment, wherein the VH gene segment is selected from the group consisting of (i) IGHV1-18*01 and the genome of the human comprises a human IGHV1-18*01 nucleotide sequence or the human expresses antibodies comprising variable domains derived from the recombination of human IGHV1-18*01; or (ii) IGVH1-46*01 and the genome of the human comprises a human IGHV1-46*01 nucleotide sequence or the human expresses antibodies comprising variable domains derived from the recombination of human IGHV1-46*01.

For example, the ligand of the invention comprises or consists of an antibody that comprises a VL domain that is derived from the recombination of a human VL gene segment and a human JL gene segment, wherein the VL gene segment is selected from the group consisting of (i) IGKV4-1*01 and the genome of the human comprises a human IGKV4-1*01 nucleotide sequence or the human expresses antibodies comprising variable domains derived from the recombination of human IGKV4-1*01; (ii) IGLV2-14*01 and the genome of the human comprises a human IGLV2-14*01 nucleotide sequence or the human expresses antibodies comprising variable domains derived from the recombination of human IGLV2-14*01; or (iii) IGKV1-13*02 and the genome of the human comprises a human IGKV1-13*02 nucleotide sequence or the human expresses antibodies comprising variable domains derived from the recombination of human IGKV1-13*02.

For example, the inventor identified the possibility of addressing the rarer IGH-gamma-1 SNPs 204D (observed cumulative frequency of 0.296) and 206L (observed cumulative frequency of 0.283) individually or in combination. These residues are part of the CH3 domain, and as such they form part of antibody Fc regions. Thus, matching of these CH3 variations with the patient is especially beneficial for reasons as discussed above. Thus, in this example the ligand of the invention comprises or consists of an antibody that comprises a human gamma-1 heavy chain constant region that comprises an Asp corresponding to position 204 of SEQ ID NO: 42 or a Leu corresponding to position 206 of SEQ ID NO: 42 and wherein the genome of the human comprises a gamma-1 heavy chain constant region nucleotide sequence that encodes such an Asp or Leu or the human expresses antibodies comprising human gamma-1 constant regions comprising such an Asp or Leu. An example of such a ligand is alirocumab.

In another example, the inventor identified the possibility of addressing IGH-gamma-2 SNPs. This included consideration of Fc region variation—in this respect, the inventor focused on positions 161 and 257 which are in the Fc region. Thus, in this example the ligand of the invention comprises or consists of an antibody that comprises a human gamma-2 heavy chain constant region that comprises an amino acid selected from the group consisting of a Pro corresponding to position 72 of SEQ ID NO: 44, an Asn corresponding to position 75 of SEQ ID NO: 44, a Phe corresponding to position 76 of SEQ ID NO: 44, a Val corresponding to position 161 of SEQ ID NO: 44 and an Ala corresponding to position 257 of SEQ ID NO: 44; and wherein the genome of the human comprises a gamma-2 heavy chain constant region nucleotide sequence that encodes such a selected amino acid or the human expresses antibodies comprising human gamma-2 constant regions comprising such a selected amino acid. An example of such a ligand is evolocumab or bococizumab.

In another example, the inventor addressed human kappa constant region variation. Thus, in this example the ligand of the invention comprises or consists of an antibody that comprises a human kappa light chain constant region that comprises a Val corresponding to position 84 of SEQ ID NO: 50 or a Cys corresponding to position 87 of SEQ ID NO: 50; and wherein the genome of the human comprises a kappa light chain constant region nucleotide sequence that encodes such a Val or Cys or the human expresses antibodies comprising human kappa light chain constant regions comprising such a Val or Cys. An example of such a ligand is alirocumab or bococizumab.

In another example, the inventor addressed human lambda constant region variation. Thus, in this example the ligand of the invention comprises or consists of an antibody that comprises a human IGLC2*01 light chain constant region; and wherein the genome of the human comprises a human IGLC2*01 nucleotide sequence or the human expresses antibodies comprising human light chain IGLC2*01 constant regions. An example of such a ligand is evolocumab.

Further exemplary ligands are in the paragraphs 1-17 as follows.

1. An antibody or antibody fragment for use in a method of
   (a) reducing cholesterol level or maintaining previously reduced cholesterol level in a human in need thereof, or
   (b) targeting PCSK9 in a human,
   wherein the antibody or fragment comprises a human gamma heavy chain constant region that comprises a first amino acid that is encoded by a human gamma heavy chain constant region gene segment SNP, and the antibody or fragment specifically binds a proprotein convertase subtilisin/kexin type 9 (PCSK9) amino acid sequence that comprises a C-terminal domain comprising a mutation selected from the group consisting of I474V, Q619P, N425S and E670G (eg, selected from I474V and E670G) in SEQ ID NO:1, wherein the human comprises a nucleotide sequence encoding said PCSK9 amino acid sequence and comprises a human gamma heavy chain constant region gene segment comprising said SNP, or the human expresses antibodies comprising human gamma constant regions comprising said first amino acid.

In an embodiment of (b), the antibody or fragment treats or reduces cholesterol level or maintains previously reduced cholesterol level in the human.

In an alternative, paragraph 1 provides:—

An antibody or antibody fragment for use in a method of (a) reducing cholesterol level or maintaining previously reduced cholesterol level in a human in need thereof, or (b) targeting PCSK9 in a human,
wherein the antibody or fragment comprises a human gamma-1 heavy chain constant region that comprises an Asp corresponding to position 204 of SEQ ID NO: 42 or a Leu corresponding to position 206 of SEQ ID NO: 42, and the antibody or fragment specifically binds a proprotein convertase subtilisin/kexin type 9 (PCSK9) amino acid sequence that comprises a C-terminal domain comprising a said PCSK9 mutation (eg, I474V or E670G) in SEQ ID NO:1, wherein the human comprises a nucleotide sequence encoding said amino acid sequence and comprises an IGHG1*01 human heavy chain constant region gene segment, or the human expresses antibodies comprising human gamma-1 constant regions comprising such an Asp and Leu.

In an embodiment, said mutation is I474V. In another embodiment, said mutation is E670G. In another embodiment, said mutation is N425S. In another embodiment, said mutation is Q619P.

In an embodiment of (b), the antibody or fragment treats or reduces cholesterol level or maintains previously reduced cholesterol level in the human.

An example provides:—

An antibody or antibody fragment for use in a method of (a) reducing cholesterol level or maintaining previously reduced cholesterol level in a human in need thereof, or (b) targeting PCSK9 in a human,
wherein the antibody or fragment comprises a human gamma-1 heavy chain constant region that comprises an Asp corresponding to position 204 of SEQ ID NO: 42 and a Leu corresponding to position 206 of SEQ ID NO: 42, and the antibody or fragment specifically binds a proprotein convertase subtilisin/kexin type 9 (PCSK9) amino acid sequence that comprises a C-terminal domain comprising a mutation I474V in SEQ ID NO:1, wherein the human comprises a nucleotide sequence encoding said amino acid sequence and comprises an IGHG1*01 human heavy chain constant region gene segment. Optionally, the antibody or fragment comprises an IGHG1*01 human heavy chain constant region.

In an embodiment of (b), the antibody or fragment treats or reduces cholesterol level or maintains previously reduced cholesterol level in the human.

Another example provides:—

An antibody or antibody fragment for use in a method of (a) reducing cholesterol level or maintaining previously reduced cholesterol level in a human in need thereof, or (b) targeting PCSK9 in a human,
wherein the antibody or fragment comprises a human gamma-1 heavy chain constant region that comprises an Asp corresponding to position 204 of SEQ ID NO: 42 and a Leu corresponding to position 206 of SEQ ID NO: 42, and the antibody or fragment specifically binds a proprotein convertase subtilisin/kexin type 9 (PCSK9) amino acid sequence that comprises a C-terminal domain comprising a mutation E670G in SEQ ID NO:1, wherein the human comprises a nucleotide sequence encoding said amino acid sequence and comprises an IGHG1*01 human heavy chain constant region gene segment. Optionally, the antibody or fragment comprises an IGHG1*01 human heavy chain constant region.

In an embodiment of (b), the antibody or fragment treats or reduces cholesterol level or maintains previously reduced cholesterol level in the human.

In an example, said antibody or antibody fragment has been determined to specifically bind a proprotein convertase subtilisin/kexin type 9 (PCSK9) that comprises a C-terminal domain comprising a mutation selected from the group consisting of I474V, Q619P, N425S and E670G (eg, selected from I474V and E670G) in SEQ ID NO: 1, wherein the antibody or fragment comprises a human gamma-1 heavy chain constant region that comprises an Asp corresponding to position 204 of SEQ ID NO: 42 and a Leu corresponding to position 206 of SEQ ID NO: 42 and wherein said human comprises (i) an IGHG1*01 human heavy chain constant region gene segment and (ii) a nucleotide sequence encoding said proprotein convertase subtilisin/kexin type 9 (PCSK9)

that comprises a C-terminal domain comprising said mutation (eg, I474V or E670G) in SEQ ID NO: 1.
2. The antibody or antibody fragment of paragraph 1, wherein the antibody comprises a human gamma-1 heavy chain constant region that comprises an Asp corresponding to position 204 of SEQ ID NO: 42 and a Leu corresponding to position 206 of SEQ ID NO: 42.
3. The antibody or antibody fragment of paragraph 1 or 2, wherein the antibody comprises an IGHG1*01 human heavy chain constant region.
4. The antibody or antibody fragment of any one of paragraphs 1 to 3, wherein the human has been determined to comprise the nucleotide sequence that encodes a PCSK9 comprising a C-terminal domain comprising said mutation (eg, I474V or E670G) in SEQ ID NO: 1 and/or a proprotein convertase subtilisin/kexin type 9 (PCSK9) variant protein encoded by the nucleotide sequence of SEQ ID NO: 29 or 30.
5. The antibody or antibody fragment of any one of paragraphs 1 to 4, the method comprising the step of determining that the human comprises the nucleotide sequence that encodes a PCSK9 comprising a C-terminal domain comprising said mutation (eg, I474V or E670G) and/or a proprotein convertase subtilisin/kexin type 9 (PCSK9) variant protein comprising said mutation (eg, I474V or E670G), optionally, wherein the determining step is performed before administration of the antibody to the human.
6. The antibody or antibody fragment of paragraph 5, wherein the step of determining comprises assaying a biological sample from the human for a nucleotide sequence encoding the PCSK9 that comprises the C-terminal domain comprising the mutation (eg, I474V or E670G) in SEQ ID NO: 1.
7. The antibody or antibody fragment of paragraph 6, wherein the assaying comprises contacting the biological sample with
  a. at least one oligonucleotide probe comprising a sequence of at least 10 contiguous nucleotides that can specifically hybridize to and identify in the biological sample a nucleotide sequence encoding the PCSK9 that comprises the C-terminal domain comprising the mutation (eg, I474V or E670G) in SEQ ID NO: 1 or that specifically hybridizes to an antisense of said sequence, wherein said nucleic acid hybridizes to at least one nucleotide present in said selected sequence which is not present in SEQ ID NO: 28 or hybridizes to an antisense sequence thereby forming a complex when at least one nucleotide sequence encoding the PCSK9 that comprises the C-terminal domain comprising the mutation (eg, I474V or E670G) in SEQ ID NO: 1 is present; and/or
  b. at least one oligonucleotide probe comprising a sequence of at least 10 contiguous nucleotides of a nucleotide sequence encoding the PCSK9 that comprises the C-terminal domain comprising the mutation (eg, I474V or E670G) in SEQ ID NO: 1 or comprising an antisense sequence of said contiguous nucleotides, wherein said sequence of contiguous nucleotides comprises at least one nucleotide present in said selected sequence which is not present in SEQ ID NO: 28 thereby forming a complex when the nucleotide sequence encoding the PCSK9 that comprises a C-terminal domain comprising the mutation (eg, I474V or E670G) in SEQ ID NO: 1 is present; and detecting the presence or absence of the complex, wherein detecting the presence of the complex determines that the human comprises the PCSK9 that comprises the C-terminal domain comprising the mutation (eg, I474V or E670G) in SEQ ID NO: 1.
8. The antibody or antibody fragment of paragraph 6 or 7, wherein the assaying comprises nucleic acid amplification and optionally one or more methods selected from sequencing, next generation sequencing, nucleic acid hybridization, and allele-specific amplification and/or wherein the assaying is performed in a multiplex format.
9. The antibody or antibody fragment of any one of paragraphs 1 to 8, wherein said antibody or antibody fragment is for administration to a human that is or has been further determined to be substantially resistant to statin treatment.
10. The antibody or antibody fragment of any one of paragraphs 1 to 9, wherein antibody or antibody fragment is for administration to a human that is receiving or has received statin treatment or has reduced responsiveness to statin treatment.
11. The antibody or antibody fragment of paragraph 9 or 10, wherein said antibody or antibody fragment is for administration to the human separately or simultaneously with said statin treatment.
12. The antibody or antibody fragment of any one of paragraphs 6 to 10, wherein said biological sample comprises serum, blood, feces, tissue, a cell, urine and/or saliva of said human.
13. The antibody or antibody fragment of any one of paragraphs 1 to 12, wherein said human is indicated as heterozygous for a nucleotide sequence encoding the PCSK9 C-terminal domain comprising a said PCSK9 mutation (eg, I474V or E670G), optionally, wherein said human is further indicated as comprising the nucleotide sequence of SEQ ID NO: 28, or said human is indicated as homozygous for a nucleotide sequence encoding the PCSK9 C-terminal domain comprising a said PCSK9 mutation (eg, I474V or E670G) in SEQ ID NO: 1.
14. The antibody or antibody fragment of any one of paragraphs 1 to 13, wherein said human has been diagnosed with at least one condition selected from a lipid disorder, hyperlipoproteinemia, hyperlipidemia, dyslipidemia, hypercholesterolemia, a heart attack, a stroke, coronary heart disease, atherosclerosis, peripheral vascular disease, claudication (eg, claudication associated with elevated cholesterol) and high blood pressure.
15. The antibody or antibody fragment of any one of paragraphs 1 to 14, wherein said antibody or antibody fragment treats or reduces the risk in said human of at least one condition selected from a lipid disorder, hyperlipoproteinemia, hyperlipidemia, dyslipidemia, hypercholesterolemia, a heart attack, a stroke, coronary heart disease, atherosclerosis, peripheral vascular disease, claudication (eg, claudication associated with elevated cholesterol) and high blood pressure.
16. The antibody or antibody fragment of any one of paragraphs 1 to 15, wherein the nucleotide sequence is SEQ ID NO: 29 or 30.
17. The antibody or antibody fragment of any one of paragraphs 1 to 16, wherein said antibody or antibody fragment is for administration by intravenous or subcutaneous administration and/or is comprised in an injectable preparation.

Further exemplary methods are in the paragraphs 1-18 as follows.
1. A method of (a) reducing cholesterol level or maintaining previously reduced cholesterol level in a human in need thereof or (b) targeting PCSK9 in a human, the method comprising administering to said human an antibody or antibody fragment that specifically binds a proprotein convertase subtilisin/kexin type 9 (PCSK9) that comprises a C-terminal domain comprising a said PCSK9 mutation (eg, I474V or E670G) in SEQ ID NO: 1, wherein the antibody or fragment comprises a human gamma-1 heavy chain constant region that comprises an Asp corresponding to position 204 of SEQ ID NO: 42 or a Leu corresponding to position 206 of SEQ ID NO: 42 and wherein said human comprises (i) an IGHG1*01 human heavy chain constant region gene segment, or the human expresses antibodies comprising human gamma-1 heavy chain constant regions comprising such an Asp and Leu and (ii) a nucleotide sequence encoding said proprotein convertase subtilisin/kexin type 9 (PCSK9) that comprises a C-terminal domain comprising said mutation (eg, I474V or E670G) in SEQ ID NO: 1.

In an embodiment, said mutation is I474V. In another embodiment, said mutation is E670G.

In an embodiment of (b), the antibody or fragment treats or reduces cholesterol level or maintains previously reduced cholesterol level in the human.

An example provides:—

A method of (a) reducing cholesterol level or maintaining previously reduced cholesterol level in a human in need thereof or (b) targeting PCSK9 in a human,
the method comprising administering to said human an antibody or antibody fragment that specifically binds a proprotein convertase subtilisin/kexin type 9 (PCSK9) that comprises a C-terminal domain comprising a mutation I474 in SEQ ID NO: 1, wherein the antibody or fragment comprises a human gamma-1 heavy chain constant region that comprises an Asp corresponding to position 204 of SEQ ID NO: 42 and a Leu corresponding to position 206 of SEQ ID NO: 42 and wherein said human comprises (i) an IGHG1*01 human heavy chain constant region gene segment and (ii) a nucleotide sequence encoding said proprotein convertase subtilisin/kexin type 9 (PCSK9) that comprises a C-terminal domain comprising said mutation I474V in SEQ ID NO: 1. Optionally, the antibody or fragment comprises a IGHG1*01 human heavy chain constant region.

In an embodiment of (b), the antibody or fragment treats or reduces cholesterol level or maintains previously reduced cholesterol level in the human.

Another example provides:—

A method of (a) reducing cholesterol level or maintaining previously reduced cholesterol level in a human in need thereof or (b) targeting PCSK9 in a human,
the method comprising administering to said human an antibody or antibody fragment that specifically binds a proprotein convertase subtilisin/kexin type 9 (PCSK9) that comprises a C-terminal domain comprising a mutation E670G in SEQ ID NO: 1, wherein the antibody or fragment comprises a human gamma-1 heavy chain constant region that comprises an Asp corresponding to position 204 of SEQ ID NO: 42 and a Leu corresponding to position 206 of SEQ ID NO: 42 and wherein said human comprises (i) an IGHG1*01 human heavy chain constant region gene segment and (ii) a nucleotide sequence encoding said proprotein convertase subtilisin/kexin type 9 (PCSK9) that comprises a C-terminal domain comprising said mutation E670G in SEQ ID NO: 1. Optionally, the antibody or fragment comprises an IGHG1*01 human heavy chain constant region.

In an embodiment of (b), the antibody or fragment treats or reduces cholesterol level or maintains previously reduced cholesterol level in the human.

In an example, said antibody or antibody fragment has been determined to specifically bind a proprotein convertase subtilisin/kexin type 9 (PCSK9) that comprises a C-terminal domain comprising a said PCSK9 mutation (eg, I474V or E670G) in SEQ ID NO: 1, wherein the antibody or fragment comprises a human gamma-1 heavy chain constant region that comprises an Asp corresponding to position 204 of SEQ ID NO: 42 and a Leu corresponding to position 206 of SEQ ID NO: 42 and wherein said human comprises (i) an IGHG1*01 human heavy chain constant region gene segment and (ii) a nucleotide sequence encoding said proprotein convertase subtilisin/kexin type 9 (PCSK9) that comprises a C-terminal domain comprising said mutation (eg, I474V or E670G) in SEQ ID NO: 1.

2. The method of paragraph 1, comprising, before said administering, selecting a human comprising said nucleotide sequence of (ii), wherein the human is the human of paragraph 1.

3. The method of paragraph 1 or 2, wherein the antibody comprises a human gamma-1 heavy chain constant region that comprises an Asp corresponding to position 204 of SEQ ID NO: 42 and a Leu corresponding to position 206 of SEQ ID NO: 42.

4. The method of paragraph 1, 2 or 3, wherein the antibody comprises an IGHG1*01 human heavy chain constant region.

5. The method of any one of paragraphs 1 to 4, wherein the human has been determined to comprise the nucleotide sequence that encodes a PCSK9 comprising a C-terminal domain comprising said mutation (eg, I474V or E670G) in SEQ ID NO: 1 and/or a proprotein convertase subtilisin/kexin type 9 (PCSK9) variant protein encoded by the nucleotide sequence of SEQ ID NO: 29 or 30.

6. The method of any one of paragraphs 1 to 5, comprising the step of determining that the human comprises the nucleotide sequence that encodes a PCSK9 comprising a C-terminal domain comprising said mutation (eg, I474V or E670G) and/or a proprotein convertase subtilisin/kexin type 9 (PCSK9) variant protein comprising said mutation (eg, I474V or E670G), optionally, wherein the determining step is performed before administration of the antibody to the human.

7. The method of paragraph 6, wherein the step of determining comprises assaying a biological sample from the human for a nucleotide sequence encoding the PCSK9 that comprises the C-terminal domain comprising the mutation (eg, I474V or E670G) in SEQ ID NO: 1.

8. The method of paragraph 7, wherein the assaying comprises contacting the biological sample with
   a. at least one oligonucleotide probe comprising a sequence of at least 10 contiguous nucleotides that can specifically hybridize to and identify in the biological sample a nucleotide sequence encoding the PCSK9 that comprises the C-terminal domain comprising the mutation (eg, I474V or E670G) in SEQ ID NO: 1 or that specifically hybridizes to an antisense of said sequence, wherein said nucleic acid hybridizes to at least one nucleotide present in said selected sequence which is not present in SEQ ID NO: 28 or hybridizes to an antisense sequence thereby forming a complex when at least one nucleotide sequence encoding the PCSK9 that comprises the C-terminal domain comprising the mutation (eg, I474V or E670G) in SEQ ID NO: 1 is present; and/or
   b. at least one oligonucleotide probe comprising a sequence of at least 10 contiguous nucleotides of a nucleotide sequence encoding the PCSK9 that comprises the C-terminal domain comprising the mutation (eg, I474V or E670G) in SEQ ID NO: 1 or comprising an antisense sequence of said contiguous nucleotides, wherein said sequence of contiguous nucleotides comprises at least one nucleotide present in said selected sequence which is not present in SEQ ID NO: 28 thereby forming a complex when the nucleotide sequence encoding the PCSK9 that comprises a C-terminal domain comprising the mutation (eg, I474V or E670G) in SEQ ID NO: 1 is present; and detecting the presence or absence of the complex, wherein detecting the presence of the complex determines that the human comprises the PCSK9 that comprises the C-terminal domain comprising the mutation (eg, I474V or E670G) in SEQ ID NO: 1.

9. The method of paragraph 7 or 8, wherein the assaying comprises nucleic acid amplification and optionally one or more methods selected from sequencing, next generation sequencing, nucleic acid hybridization, and allele-specific amplification and/or wherein the assaying is performed in a multiplex format.

10. The method of any one of paragraphs 1 to 9, wherein said human is or has been further determined to be substantially resistant to statin treatment.

11. The method of any one of paragraphs 1 to 10, wherein said human is receiving or has received statin treatment or has reduced responsiveness to statin treatment.

12. The method of paragraph 10 or 11, wherein said antibody or antibody fragment is administered to the human separately or simultaneously with said statin treatment.

13. The method of any one of paragraphs 7 to 9, wherein said biological sample comprises serum, blood, feces, tissue, a cell, urine and/or saliva of said human.

14. The method of any one of paragraphs 1 to 13, wherein said human is indicated as heterozygous for a nucleotide sequence encoding the PCSK9 C-terminal domain comprising said mutation (eg, I474V or E670G), optionally, wherein said human is further indicated as comprising the nucleotide sequence of SEQ ID NO: 28, or said human is indicated as homozygous for a nucleotide sequence encoding the PCSK9 C-terminal domain comprising said mutation I474V or E670G in SEQ ID NO: 1.

15. The method of any one of paragraphs 1 to 14, wherein said human has been diagnosed with at least one condition selected from a lipid disorder, hyperlipoproteinemia, hyperlipidemia, dyslipidemia, hypercholesterolemia, a heart attack, a stroke, coronary heart disease, atherosclerosis, peripheral vascular disease, claudication (eg, claudication associated with elevated cholesterol) and high blood pressure.

16. The method of any one of paragraphs 1 to 15, wherein said antibody or antibody fragment treats or reduces the risk in said human of at least one condition selected from a lipid disorder, hyperlipoproteinemia, hyperlipidemia, dyslipidemia, hypercholesterolemia, a heart attack, a stroke, coronary heart disease, atherosclerosis, peripheral vascular disease, claudication (eg, claudication associated with elevated cholesterol) and high blood pressure.

17. The method of any one of paragraphs 1 to 16, wherein the nucleotide sequence is SEQ ID NO: 29 or 30.

18. The method of any one of paragraphs 1 to 17, wherein said antibody or antibody fragment is administered by intravenous or subcutaneous administration and/or is comprised in an injectable preparation.

Further exemplary ligands are in the paragraphs 1-17 as follows.

1. An antibody or antibody fragment for use in a method of (a) reducing cholesterol level or maintaining previously reduced cholesterol level in a human in need thereof or (b) targeting PCSK9 in a human,
wherein the antibody comprises a human gamma-2 heavy chain constant region that comprises an amino acid selected from the group consisting of a Pro corresponding to position 72 of SEQ ID NO: 44, an Asn corresponding to position 75 of SEQ ID NO: 44, a Phe corresponding to position 76 of SEQ ID NO: 44, a Val corresponding to position 161 of SEQ ID NO: 44 and an Ala corresponding to position 257 of SEQ ID NO: 44, and the antibody or fragment specifically binds a proprotein convertase subtilisin/kexin type 9 (PCSK9) amino acid sequence that comprises a C-terminal domain comprising a said PCSK9 mutation (eg, I474V or E670G) in SEQ ID NO:1, wherein the human comprises a nucleotide sequence encoding said amino acid sequence and comprises an IGHG2*01 human heavy chain constant region gene segment, or the human expresses antibodies comprising human gamma-2 constant regions comprising such a Pro, Asn, Phe, Val and Ala.

In an embodiment, said mutation is I474V. In another embodiment, said mutation is E670G.

In an embodiment of (b), the antibody or fragment treats or reduces cholesterol level or maintains previously reduced cholesterol level in the human.

An example provides:—

An antibody or antibody fragment for use in a method of (a) reducing cholesterol level or maintaining previously reduced cholesterol level in a human in need thereof or (b) targeting PCSK9 in a human,
wherein the antibody comprises a human gamma-2 heavy chain constant region that comprises a Pro corresponding to position 72 of SEQ ID NO: 44, an Asn corresponding to position 75 of SEQ ID NO: 44, a Phe corresponding to position 76 of SEQ ID NO: 44, a Val corresponding to position 161 of SEQ ID NO: 44 and an Ala corresponding to position 257 of SEQ ID NO: 44, and the antibody or fragment specifically binds a proprotein convertase subtilisin/kexin type 9 (PCSK9) amino acid sequence that comprises a C-terminal domain comprising a mutation I474V in SEQ ID NO:1, wherein the human comprises a nucleotide sequence encoding said amino acid sequence and comprises an IGHG2*01 human heavy chain constant region gene segment. Optionally, the antibody or fragment comprises an IGHG2*01 human heavy chain constant In an embodiment of (b), the antibody or fragment treats or reduces cholesterol level or maintains previously reduced cholesterol level in the human.region.

Another example provides:—

An antibody or antibody fragment for use in a method of (a) reducing cholesterol level or maintaining previously reduced cholesterol level in a human in need thereof or (b) targeting PCSK9 in a human,
wherein the antibody comprises a human gamma-2 heavy chain constant region that comprises a Pro corresponding to position 72 of SEQ ID NO: 44, an Asn corresponding to position 75 of SEQ ID NO: 44, a Phe corresponding to position 76 of SEQ ID NO: 44, a Val corresponding to position 161 of SEQ ID NO: 44 and an Ala corresponding to position 257 of SEQ ID NO: 44, and the antibody or fragment specifically binds a proprotein convertase subtilisin/kexin type 9 (PCSK9) amino acid sequence that comprises a C-terminal domain comprising a mutation E670G in SEQ ID NO:1, wherein the human comprises a nucleotide sequence encoding said amino acid sequence and comprises an IGHG2*01 human heavy chain constant region gene segment. Optionally, the antibody or fragment comprises an IGHG2*01 human heavy chain constant region.

In an embodiment of (b), the antibody or fragment treats or reduces cholesterol level or maintains previously reduced cholesterol level in the human.

In an example, said antibody or antibody fragment has been determined to specifically bind a proprotein convertase subtilisin/kexin type 9 (PCSK9) that comprises a C-terminal domain comprising a said PCSK9 mutation (eg, I474V or E670G) in SEQ ID NO: 1, wherein the antibody or fragment comprises a human gamma-2 heavy chain constant region that comprises a Pro corresponding to position 72 of SEQ ID NO: 44, an Asn corresponding to position 75 of SEQ ID NO: 44, a Phe corresponding to position 76 of SEQ ID NO: 44, a Val corresponding to position 161 of SEQ ID NO: 44 and an Ala corresponding to position 257 of SEQ ID NO: 44 and wherein said human comprises (i) an IGHG2*01 human heavy chain constant region gene segment and (ii) a nucleotide sequence encoding said proprotein convertase subtilisin/kexin type 9 (PCSK9) that comprises a C-terminal domain comprising said mutation (eg, I474V or E670G) in SEQ ID NO: 1.

2. The antibody or antibody fragment of paragraph 1, wherein the antibody comprises a human gamma-2 heavy chain constant region that comprises a Pro corresponding to position 72 of SEQ ID NO: 44, an Asn corresponding to position 75 of SEQ ID NO: 44, a Phe corresponding to position 76 of SEQ ID NO: 44, a Val corresponding to position 161 of SEQ ID NO: 44 and an Ala corresponding to position 257 of SEQ ID NO: 44.

3. The antibody or antibody fragment of paragraph 1 or 2, wherein the antibody comprises an IGHG2*01 human heavy chain constant region.

4. The antibody or antibody fragment of any one of paragraphs 1 to 3, wherein the human has been determined to comprise the nucleotide sequence that encodes a PCSK9 comprising a C-terminal domain comprising said mutation (eg, I474V or E670G) in SEQ ID NO: 1 and/or a proprotein convertase subtilisin/kexin type 9 (PCSK9) variant protein encoded by the nucleotide sequence of SEQ ID NO: 29 or 30.

5. The antibody or antibody fragment of any one of paragraphs 1 to 4, the method comprising the step of determining that the human comprises the nucleotide sequence that encodes a PCSK9 comprising a C-terminal domain comprising said mutation (eg, I474V or E670G) and/or a proprotein convertase subtilisin/kexin type 9 (PCSK9) variant protein comprising said mutation (eg, I474V or E670G), optionally, wherein the determining step is performed before administration of the antibody to the human.

6. The antibody or antibody fragment of paragraph 5, wherein the step of determining comprises assaying a biological sample from the human for a nucleotide sequence encoding the PCSK9 that comprises the C-terminal domain comprising the mutation (eg, I474V or E670G) in SEQ ID NO: 1.

7. The antibody or antibody fragment of paragraph 6, wherein the assaying comprises contacting the biological sample with
   a. at least one oligonucleotide probe comprising a sequence of at least 10 contiguous nucleotides that can specifically hybridize to and identify in the biological sample a nucleotide sequence encoding the PCSK9 that comprises the C-terminal domain comprising the mutation (eg, I474V or E670G) in SEQ ID NO: 1 or that specifically hybridizes to an antisense of said sequence, wherein said nucleic acid hybridizes to at least one nucleotide present in said selected sequence which is not present in SEQ ID NO: 28 or hybridizes to an antisense sequence thereby forming a complex when at least one nucleotide sequence encoding the PCSK9 that comprises the C-terminal domain comprising the mutation (eg, I474V or E670G) in SEQ ID NO: 1 is present; and/or
   b. at least one oligonucleotide probe comprising a sequence of at least 10 contiguous nucleotides of a nucleotide sequence encoding the PCSK9 that comprises the C-terminal domain comprising the mutation (eg, I474V or E670G) in SEQ ID NO: 1 or comprising an antisense sequence of said contiguous nucleotides, wherein said sequence of contiguous nucleotides comprises at least one nucleotide present in said selected sequence which is not present in SEQ ID NO: 28 thereby forming a complex when the nucleotide sequence encoding the PCSK9 that comprises a C-terminal domain comprising the mutation (eg, I474V or E670G) in SEQ ID NO: 1 is present; and detecting the presence or absence of the complex, wherein detecting the presence of the complex determines that the human comprises the PCSK9 that comprises the C-terminal domain comprising the mutation (eg, I474V or E670G) in SEQ ID NO: 1.

8. The antibody or antibody fragment of paragraph 6 or 7, wherein the assaying comprises nucleic acid amplification and optionally one or more methods selected from sequencing, next generation sequencing, nucleic acid hybridization, and allele-specific amplification and/or wherein the assaying is performed in a multiplex format.

9. The antibody or antibody fragment of any one of paragraphs 1 to 8, wherein said antibody or antibody fragment is for administration to a human that is or has been further determined to be substantially resistant to statin treatment.

10. The antibody or antibody fragment of any one of paragraphs 1 to 9, wherein antibody or antibody fragment is for administration to a human that is receiving or has received statin treatment or has reduced responsiveness to statin treatment.

11. The antibody or antibody fragment of paragraph 9 or 10, wherein said antibody or antibody fragment is for administration to the human separately or simultaneously with said statin treatment.

12. The antibody or antibody fragment of any one of paragraphs 6 to 8, wherein said biological sample comprises serum, blood, feces, tissue, a cell, urine and/or saliva of said human.

13. The antibody or antibody fragment of any one of paragraphs 1 to 12, wherein said human is indicated as heterozygous for a nucleotide sequence encoding the PCSK9 C-terminal domain comprising a said PCSK9 mutation (eg, I474V or E670G), optionally, wherein said human is further indicated as comprising the nucleotide sequence of SEQ ID NO: 28, or said human is indicated as homozygous for a nucleotide sequence encoding the PCSK9 C-terminal domain comprising a mutation I474V or E670G in SEQ ID NO: 1.

14. The antibody or antibody fragment of any one of paragraphs 1 to 13, wherein said human has been diagnosed with at least one condition selected from a lipid disorder, hyperlipoproteinemia, hyperlipidemia, dyslipidemia, hypercholesterolemia, a heart attack, a stroke, coronary heart disease, atherosclerosis, peripheral vascular disease, claudication (eg, claudication associated with elevated cholesterol) and high blood pressure.

15. The antibody or antibody fragment of any one of paragraphs 1 to 14, wherein said antibody or antibody fragment treats or reduces the risk in said human of at least one condition selected from a lipid disorder, hyperlipoproteinemia, hyperlipidemia, dyslipidemia, hypercholesterolemia, a heart attack, a stroke, coronary heart disease, atherosclerosis, peripheral vascular disease, claudication (eg, claudication associated with elevated cholesterol) and high blood pressure.
16. The antibody or antibody fragment of any one of paragraphs 1 to 15, wherein the nucleotide sequence is SEQ ID NO: 29 or 30.
17. The antibody or antibody fragment of any one of paragraphs 1 to 16, wherein said antibody or antibody fragment is for administration by intravenous or subcutaneous administration and/or is comprised in an injectable preparation.

Further exemplary methods are in the paragraphs 1-18 as follows.

1. A method of (a) reducing cholesterol level or maintaining previously reduced cholesterol level in a human in need thereof or (b) targeting PCSK9 in a human,
the method comprising administering to said human an antibody or antibody fragment that specifically binds a proprotein convertase subtilisin/kexin type 9 (PCSK9) that comprises a C-terminal domain comprising a said PCSK9 mutation (eg, I474V or E670G) in SEQ ID NO: 1, wherein the antibody or fragment comprises a human gamma-2 heavy chain constant region that comprises an amino acid selected from the group consisting of a Pro corresponding to position 72 of SEQ ID NO: 44, an Asn corresponding to position 75 of SEQ ID NO: 44, a Phe corresponding to position 76 of SEQ ID NO: 44, a Val corresponding to position 161 of SEQ ID NO: 44 and an Ala corresponding to position 257 of SEQ ID NO: 44 and wherein said human comprises (i) an IGHG2*01 human heavy chain constant region gene segment, or the human expresses antibodies comprising human gamma-2 heavy chain constant regions comprising such a Pro, Asn, Phe, Val and Ala and (ii) a nucleotide sequence encoding said proprotein convertase subtilisin/kexin type 9 (PCSK9) that comprises a C-terminal domain comprising said mutation (eg, I474V or E670G) in SEQ ID NO: 1.

In an embodiment, said mutation is I474V. In another embodiment, said mutation is E670G.

In an embodiment of (b), the antibody or fragment treats or reduces cholesterol level or maintains previously reduced cholesterol level in the human.

An example provides:—

A method of (a) reducing cholesterol level or maintaining previously reduced cholesterol level in a human in need thereof or (b) targeting PCSK9 in a human,
the method comprising administering to said human an antibody or antibody fragment that specifically binds a proprotein convertase subtilisin/kexin type 9 (PCSK9) that comprises a C-terminal domain comprising a mutation I474 in SEQ ID NO: 1, wherein the antibody or fragment comprises a human gamma-2 heavy chain constant region that comprises a Pro corresponding to position 72 of SEQ ID NO: 44, an Asn corresponding to position 75 of SEQ ID NO: 44, a Phe corresponding to position 76 of SEQ ID NO: 44, a Val corresponding to position 161 of SEQ ID NO: 44 and an Ala corresponding to position 257 of SEQ ID NO: 44 and wherein said human comprises (i) an IGHG2*01 human heavy chain constant region gene segment and (ii) a nucleotide sequence encoding said proprotein convertase subtilisin/kexin type 9 (PCSK9) that comprises a C-terminal domain comprising said mutation I474V in SEQ ID NO: 1. Optionally, the antibody or fragment comprises an IGHG2*01 human heavy chain constant region.

In an embodiment of (b), the antibody or fragment treats or reduces cholesterol level or maintains previously reduced cholesterol level in the human.

Another example provides:—

A method of (a) reducing cholesterol level or maintaining previously reduced cholesterol level in a human in need thereof or (b) targeting PCSK9 in a human,
the method comprising administering to said human an antibody or antibody fragment that specifically binds a proprotein convertase subtilisin/kexin type 9 (PCSK9) that comprises a C-terminal domain comprising a mutation E670G in SEQ ID NO: 1, wherein the antibody or fragment comprises a human gamma-2 heavy chain constant region that comprises a Pro corresponding to position 72 of SEQ ID NO: 44, an Asn corresponding to position 75 of SEQ ID NO: 44, a Phe corresponding to position 76 of SEQ ID NO: 44, a Val corresponding to position 161 of SEQ ID NO: 44 and an Ala corresponding to position 257 of SEQ ID NO: 44 and wherein said human comprises (i) an IGHG2*01 human heavy chain constant region gene segment and (ii) a nucleotide sequence encoding said proprotein convertase subtilisin/kexin type 9 (PCSK9) that comprises a C-terminal domain comprising said mutation E670G in SEQ ID NO: 1. Optionally, the antibody or fragment comprises an IGHG2*01 human heavy chain constant region.

In an embodiment of (b), the antibody or fragment treats or reduces cholesterol level or maintains previously reduced cholesterol level in the human.

In an example, said antibody or antibody fragment has been determined to specifically bind a proprotein convertase subtilisin/kexin type 9 (PCSK9) that comprises a C-terminal domain comprising a said PCSK9 mutation (eg, I474V or E670G) in SEQ ID NO: 1, wherein the antibody or fragment comprises a human gamma-2 heavy chain constant region that comprises a Pro corresponding to position 72 of SEQ ID NO: 44, an Asn corresponding to position 75 of SEQ ID NO: 44, a Phe corresponding to position 76 of SEQ ID NO: 44, a Val corresponding to position 161 of SEQ ID NO: 44 and an Ala corresponding to position 257 of SEQ ID NO: 44 and wherein said human comprises (i) an IGHG2*01 human heavy chain constant region gene segment and (ii) a nucleotide sequence encoding said proprotein convertase subtilisin/kexin type 9 (PCSK9) that comprises a C-terminal domain comprising said mutation (eg, I474V or E670G) in SEQ ID NO: 1.

2. The method of paragraph 1, comprising, before said administering, selecting said human comprising said nucleotide sequence of (ii).
3. The method of paragraph 1 or 2, wherein the antibody comprises a human gamma-1 heavy chain constant region that comprises a Pro corresponding to position 72 of SEQ ID NO: 44, an Asn corresponding to position 75 of SEQ ID NO: 44, a Phe corresponding to position 76 of SEQ ID NO: 44, a Val corresponding to position 161 of SEQ ID NO: 44 and an Ala corresponding to position 257 of SEQ ID NO: 44.
4. The method of paragraph 1, 2 or 3, wherein the antibody comprises an IGHG2*01 human heavy chain constant region.
5. The method of any one of paragraphs 1 to 4, wherein the human has been determined to comprise the nucleotide sequence that encodes a PCSK9 comprising a C-terminal domain comprising said mutation (eg, I474V or E670G) in SEQ ID NO: 1 and/or a proprotein convertase subtilisin/kexin type 9 (PCSK9) variant protein encoded by the nucleotide sequence of SEQ ID NO: 29 or 30.

6. The method of any one of paragraphs 1 to 5, comprising the step of determining that the human comprises the nucleotide sequence that encodes a PCSK9 comprising a C-terminal domain comprising said mutation (eg, I474V or E670G) and/or a proprotein convertase subtilisin/kexin type 9 (PCSK9) variant protein comprising said mutation (eg, I474V or E670G), optionally, wherein the determining step is performed before administration of the antibody to the human.

7. The method of paragraph 6, wherein the step of determining comprises assaying a biological sample from the human for a nucleotide sequence encoding the PCSK9 that comprises the C-terminal domain comprising the mutation (eg, I474V or E670G) in SEQ ID NO: 1.

8. The method of paragraph 7, wherein the assaying comprises contacting the biological sample with
   a. at least one oligonucleotide probe comprising a sequence of at least 10 contiguous nucleotides that can specifically hybridize to and identify in the biological sample a nucleotide sequence encoding the PCSK9 that comprises the C-terminal domain comprising the mutation (eg, I474V or E670G) in SEQ ID NO: 1 or that specifically hybridizes to an antisense of said sequence, wherein said nucleic acid hybridizes to at least one nucleotide present in said selected sequence which is not present in SEQ ID NO: 28 or hybridizes to an antisense sequence thereby forming a complex when at least one nucleotide sequence encoding the PCSK9 that comprises the C-terminal domain comprising the mutation (eg, I474V or E670G) in SEQ ID NO: 1 is present; and/or
   b. at least one oligonucleotide probe comprising a sequence of at least 10 contiguous nucleotides of a nucleotide sequence encoding the PCSK9 that comprises the C-terminal domain comprising the mutation (eg, I474V or E670G) in SEQ ID NO: 1 or comprising an antisense sequence of said contiguous nucleotides, wherein said sequence of contiguous nucleotides comprises at least one nucleotide present in said selected sequence which is not present in SEQ ID NO: 28 thereby forming a complex when the nucleotide sequence encoding the PCSK9 that comprises a C-terminal domain comprising the mutation (eg, I474V or E670G) in SEQ ID NO: 1 is present; and detecting the presence or absence of the complex, wherein detecting the presence of the complex determines that the human comprises the PCSK9 that comprises the C-terminal domain comprising the mutation (eg, I474V or E670G) in SEQ ID NO: 1.

9. The method of paragraph 7 or 8, wherein the assaying comprises nucleic acid amplification and optionally one or more methods selected from sequencing, next generation sequencing, nucleic acid hybridization, and allele-specific amplification and/or wherein the assaying is performed in a multiplex format.

10. The method of any one of paragraphs 1 to 9, wherein said human is or has been further determined to be substantially resistant to statin treatment.

11. The method of any one of paragraphs 1 to 10, wherein said human is receiving or has received statin treatment or has reduced responsiveness to statin treatment.

12. The method of paragraph 10 or 11, wherein said antibody or antibody fragment is administered to the human separately or simultaneously with said statin treatment.

13. The method of any one of paragraphs 7 to 9, wherein said biological sample comprises serum, blood, feces, tissue, a cell, urine and/or saliva of said human.

14. The method of any one of paragraphs 1 to 13, wherein said human is indicated as heterozygous for a nucleotide sequence encoding the PCSK9 C-terminal domain comprising said mutation (eg, I474V or E670G), optionally, wherein said human is further indicated as comprising the nucleotide sequence of SEQ ID NO: 28, or said human is indicated as homozygous for a nucleotide sequence encoding the PCSK9 C-terminal domain comprising said mutation I474V or E670G in SEQ ID NO: 1.

15. The method of any one of paragraphs 1 to 14, wherein said human has been diagnosed with at least one condition selected from a lipid disorder, hyperlipoproteinemia, hyperlipidemia, dyslipidemia, hypercholesterolemia, a heart attack, a stroke, coronary heart disease, atherosclerosis, peripheral vascular disease, claudication (eg, claudication associated with elevated cholesterol) and high blood pressure.

16. The method of any one of paragraphs 1 to 15, wherein said antibody or antibody fragment treats or reduces the risk in said human of at least one condition selected from a lipid disorder, hyperlipoproteinemia, hyperlipidemia, dyslipidemia, hypercholesterolemia, a heart attack, a stroke, coronary heart disease, atherosclerosis, peripheral vascular disease, claudication (eg, claudication associated with elevated cholesterol) and high blood pressure.

17. The method of any one of paragraphs 1 to 16, wherein the nucleotide sequence s SEQ ID NO: 29 or 30.

18. The method of any one of paragraphs 1 to 17, wherein said antibody or antibody fragment is administered by intravenous or subcutaneous administration and/or is comprised in an injectable preparation.

Further exemplary ligands are in the paragraphs 1-17 as follows.

1. An antibody or antibody fragment for use in a method of (a) reducing cholesterol level or maintaining previously reduced cholesterol level in a human in need thereof or (b) targeting PCSK9 in a human,
   wherein the antibody or fragment comprises a human kappa light chain constant region that comprises a Val corresponding to position 84 of SEQ ID NO: 50 or a Cys corresponding to position 87 of SEQ ID NO: 50, and the antibody or fragment specifically binds a proprotein convertase subtilisin/kexin type 9 (PCSK9) amino acid sequence that comprises a C-terminal domain comprising a said PCSK9 mutation (eg, I474V or E670G) in SEQ ID NO:1, wherein the human comprises a nucleotide sequence encoding said amino acid sequence and comprises an IGKC*01 human light chain constant region gene segment, or the human expresses antibodies comprising human kappa light chain constant regions comprising such an Val and Cys.

In an embodiment, said mutation is I474V. In another embodiment, said mutation is E670G.

In an embodiment of (b), the antibody or fragment treats or reduces cholesterol level or maintains previously reduced cholesterol level in the human.

An example provides:—

An antibody or antibody fragment for use in a method of (a) reducing cholesterol level or maintaining previously reduced cholesterol level in a human in need thereof or (b) targeting PCSK9 in a human, wherein the antibody or fragment comprises a human kappa light chain constant region that comprises a Val corresponding to position 84 of SEQ ID NO: 50 and a Cys corresponding to position 87 of SEQ ID NO: 50, and the antibody or fragment specifically binds a proprotein convertase subtilisin/kexin type 9 (PCSK9) amino acid sequence that comprises a C-terminal domain comprising a mutation I474V in SEQ ID NO:1, wherein the human comprises a nucleotide sequence encoding said amino acid sequence and comprises an IGKC*01 human light chain constant region gene segment. Optionally, the antibody or fragment comprises an IGKC*01 human light chain constant region.

In an embodiment of (b), the antibody or fragment treats or reduces cholesterol level or maintains previously reduced cholesterol level in the human.

Another example provides:—

An antibody or antibody fragment for use in a method of (a) reducing cholesterol level or maintaining previously reduced cholesterol level in a human in need thereof or (b) targeting PCSK9 in a human, wherein the antibody or fragment comprises a human kappa light chain constant region that comprises a Val corresponding to position 84 of SEQ ID NO: 50 and a Cys corresponding to position 87 of SEQ ID NO: 50, and the antibody or fragment specifically binds a proprotein convertase subtilisin/kexin type 9 (PCSK9) amino acid sequence that comprises a C-terminal domain comprising a mutation E670G in SEQ ID NO:1, wherein the human comprises a nucleotide sequence encoding said amino acid sequence and comprises an IGKC*01 human light chain constant region gene segment. Optionally, the antibody or fragment comprises an IGKC*01 human light chain constant region.

In an embodiment of (b), the antibody or fragment treats or reduces cholesterol level or maintains previously reduced cholesterol level in the human.

In an example, said antibody or antibody fragment has been determined to specifically bind a proprotein convertase subtilisin/kexin type 9 (PCSK9) that comprises a C-terminal domain comprising a said PCSK9 mutation (eg, I474V or E670G) in SEQ ID NO: 1, wherein the antibody or fragment comprises a human kappa light chain constant region that comprises a Val corresponding to position 84 of SEQ ID NO: 50 and a Cys corresponding to position 87 of SEQ ID NO: 50 and wherein said human comprises (i) an IGKC*01 human heavy chain constant region gene segment and (ii) a nucleotide sequence encoding said proprotein convertase subtilisin/kexin type 9 (PCSK9) that comprises a C-terminal domain comprising said mutation (eg, I474V or E670G) in SEQ ID NO: 1.

2. The antibody or antibody fragment of paragraph 1, wherein the antibody comprises a human kappa light chain constant region that comprises a Val corresponding to position 84 of SEQ ID NO: 50 or a Cys corresponding to position 87 of SEQ ID NO: 50.

3. The antibody or antibody fragment of paragraph 1 or 2, wherein the antibody comprises an IGKC*01 human kappa chain constant region.

4. The antibody or antibody fragment of any one of paragraphs 1 to 3, wherein the human has been determined to comprise the nucleotide sequence that encodes a PCSK9 comprising a C-terminal domain comprising said mutation (eg, I474V or E670G) in SEQ ID NO: 1 and/or a proprotein convertase subtilisin/kexin type 9 (PCSK9) variant protein encoded by the nucleotide sequence of SEQ ID NO: 29 or 30.

5. The antibody or antibody fragment of any one of paragraphs 1 to 4, the method comprising the step of determining that the human comprises the nucleotide sequence that encodes a PCSK9 comprising a C-terminal domain comprising said mutation (eg, I474V or E670G) and/or a proprotein convertase subtilisin/kexin type 9 (PCSK9) variant protein comprising said mutation (eg, I474V or E670G), optionally, wherein the determining step is performed before administration of the antibody to the human.

6. The antibody or antibody fragment of paragraph 5, wherein the step of determining comprises assaying a biological sample from the human for a nucleotide sequence encoding the PCSK9 that comprises the C-terminal domain comprising the mutation (eg, I474V or E670G) in SEQ ID NO: 1.

7. The antibody or antibody fragment of paragraph 6, wherein the assaying comprises contacting the biological sample with
   a. at least one oligonucleotide probe comprising a sequence of at least 10 contiguous nucleotides that can specifically hybridize to and identify in the biological sample a nucleotide sequence encoding the PCSK9 that comprises the C-terminal domain comprising the mutation (eg, I474V or E670G) in SEQ ID NO: 1 or that specifically hybridizes to an antisense of said sequence, wherein said nucleic acid hybridizes to at least one nucleotide present in said selected sequence which is not present in SEQ ID NO: 28 or hybridizes to an antisense sequence thereby forming a complex when at least one nucleotide sequence encoding the PCSK9 that comprises the C-terminal domain comprising the mutation (eg, I474V or E670G) in SEQ ID NO: 1 is present; and/or
   b. at least one oligonucleotide probe comprising a sequence of at least 10 contiguous nucleotides of a nucleotide sequence encoding the PCSK9 that comprises the C-terminal domain comprising the mutation (eg, I474V or E670G) in SEQ ID NO: 1 or comprising an antisense sequence of said contiguous nucleotides, wherein said sequence of contiguous nucleotides comprises at least one nucleotide present in said selected sequence which is not present in SEQ ID NO: 28 thereby forming a complex when the nucleotide sequence encoding the PCSK9 that comprises a C-terminal domain comprising the mutation (eg, I474V or E670G) in SEQ ID NO: 1 is present; and
   detecting the presence or absence of the complex, wherein detecting the presence of the complex determines that the human comprises the PCSK9 that comprises the C-terminal domain comprising the mutation (eg, I474V or E670G) in SEQ ID NO: 1.

8. The antibody or antibody fragment of paragraph 6 or 7, wherein the assaying comprises nucleic acid amplification and optionally one or more methods selected from sequencing, next generation sequencing, nucleic acid hybridization, and allele-specific amplification and/or wherein the assaying is performed in a multiplex format.

9. The antibody or antibody fragment of any one of paragraphs 1 to 8, wherein said antibody or antibody fragment is for administration to a human that is or has been further determined to be substantially resistant to statin treatment.

10. The antibody or antibody fragment of any one of paragraphs 1 to 9, wherein antibody or antibody fragment is for administration to a human that is receiving or has received statin treatment or has reduced responsiveness to statin treatment.

11. The antibody or antibody fragment of paragraph 9 or 10, wherein said antibody or antibody fragment is for administration to the human separately or simultaneously with said statin treatment.

12. The antibody or antibody fragment of any one of paragraphs 6 to 10, wherein said biological sample comprises serum, blood, feces, tissue, a cell, urine and/or saliva of said human.

13. The antibody or antibody fragment of any one of paragraphs 1 to 12, wherein said human is indicated as heterozygous for a nucleotide sequence encoding the PCSK9 C-terminal domain comprising a said PCSK9 mutation (eg, I474V or E670G), optionally, wherein said human is further indicated as comprising the nucleotide sequence of SEQ ID NO: 28, or said human is indicated as homozygous for a nucleotide sequence encoding the PCSK9 C-terminal domain comprising a mutation I474V or E670G in SEQ ID NO: 1.

14. The antibody or antibody fragment of any one of paragraphs 1 to 13, wherein said human has been diagnosed with at least one condition selected from a lipid disorder, hyperlipoproteinemia, hyperlipidemia, dyslipidemia, hypercholesterolemia, a heart attack, a stroke, coronary heart disease, atherosclerosis, peripheral vascular disease, claudication (eg, claudication associated with elevated cholesterol) and high blood pressure.

15. The antibody or antibody fragment of any one of paragraphs 1 to 14, wherein said antibody or antibody fragment treats or reduces the risk in said human of at least one condition selected from a lipid disorder, hyperlipoproteinemia, hyperlipidemia, dyslipidemia, hypercholesterolemia, a heart attack, a stroke, coronary heart disease, atherosclerosis, peripheral vascular disease, claudication (eg, claudication associated with elevated cholesterol) and high blood pressure.

16. The antibody or antibody fragment of any one of paragraphs 1 to 15, wherein the nucleotide sequence is SEQ ID NO: 29 or 30.

17. The antibody or antibody fragment of any one of paragraphs 1 to 16, wherein said antibody or antibody fragment is for administration by intravenous or subcutaneous administration and/or is comprised in an injectable preparation.

Further exemplary methods are in the paragraphs 1-18 as follows.

1. A method of (a) reducing cholesterol level or maintaining previously reduced cholesterol level in a human in need thereof or (b) targeting PCSK9 in a human,
the method comprising administering to said human an antibody or antibody fragment that specifically binds a proprotein convertase subtilisin/kexin type 9 (PCSK9) that comprises a C-terminal domain comprising a said PCSK9 mutation (eg, I474V or E670G) in SEQ ID NO: 1, wherein the antibody or fragment comprises a human kappa light chain constant region that comprises a Val corresponding to position 84 of SEQ ID NO: 50 or a Cys corresponding to position 87 of SEQ ID NO: 50 and wherein said human comprises (i) an IGKC*01 human light chain constant region gene segment, or the human expresses antibodies comprising human kappa light chain constant regions comprising such an Val and Cys and (ii) a nucleotide sequence encoding said proprotein convertase subtilisin/kexin type 9 (PCSK9) that comprises a C-terminal domain comprising said mutation (eg, I474V or E670G) in SEQ ID NO: 1.

In an embodiment, said mutation is I474V. In another embodiment, said mutation is E670G.

In an embodiment of (b), the antibody or fragment treats or reduces cholesterol level or maintains previously reduced cholesterol level in the human.

An example provides:—

A method of (a) reducing cholesterol level or maintaining previously reduced cholesterol level in a human in need thereof or (b) targeting PCSK9 in a human,
the method comprising administering to said human an antibody or antibody fragment that specifically binds a proprotein convertase subtilisin/kexin type 9 (PCSK9) that comprises a C-terminal domain comprising a mutation I474 in SEQ ID NO: 1, wherein the antibody or fragment comprises a human kappa light chain constant region that comprises a Val corresponding to position 84 of SEQ ID NO: 50 and a Cys corresponding to position 87 of SEQ ID NO: 50 and wherein said human comprises (i) an IGKC*01 human light chain constant region gene segment and (ii) a nucleotide sequence encoding said proprotein convertase subtilisin/kexin type 9 (PCSK9) that comprises a C-terminal domain comprising said mutation I474V in SEQ ID NO: 1. Optionally, the antibody or fragment comprises an IGKC*01 human light chain constant region.

In an embodiment of (b), the antibody or fragment treats or reduces cholesterol level or maintains previously reduced cholesterol level in the human.

Another example provides:—

A method of (a) reducing cholesterol level or maintaining previously reduced cholesterol level in a human in need thereof or (b) targeting PCSK9 in a human,
the method comprising administering to said human an antibody or antibody fragment that specifically binds a proprotein convertase subtilisin/kexin type 9 (PCSK9) that comprises a C-terminal domain comprising a mutation E670G in SEQ ID NO: 1, wherein the antibody or fragment comprises a human kappa light chain constant region that comprises a Val corresponding to position 84 of SEQ ID NO: 50 and a Cys corresponding to position 87 of SEQ ID NO: 50 and wherein said human comprises (i) an IGKC*01 human light chain constant region gene segment and (ii) a nucleotide sequence encoding said proprotein convertase subtilisin/kexin type 9 (PCSK9) that comprises a C-terminal domain comprising said mutation E670G in SEQ ID NO: 1. Optionally, the antibody or fragment comprises an IGKC*01 human light chain constant region.

In an embodiment of (b), the antibody or fragment treats or reduces cholesterol level or maintains previously reduced cholesterol level in the human.

In an example, said antibody or antibody fragment has been determined to specifically bind a proprotein convertase subtilisin/kexin type 9 (PCSK9) that comprises a C-terminal domain comprising a said PCSK9 mutation (eg, I474V or E670G) in SEQ ID NO: 1, wherein the antibody or fragment comprises a human kappa light chain constant region that comprises a Val corresponding to position 84 of SEQ ID NO: 50 and a Cys corresponding to position 87 of SEQ ID NO: 50 and wherein said human comprises (i) an IGKC*01 human heavy chain constant region gene segment and (ii) a nucleotide sequence encoding said proprotein convertase subtilisin/kexin type 9 (PCSK9) that comprises a C-terminal domain comprising said mutation (eg, I474V or E670G) in SEQ ID NO: 1.

2. The method of paragraph 1, comprising, before said administering, selecting said human comprising said nucleotide sequence of (ii).

3. The method of paragraph 1 or 2, wherein the antibody comprises a human kappa light chain constant region that comprises a Val corresponding to position 84 of SEQ ID NO: 50 or a Cys corresponding to position 87 of SEQ ID NO: 50.
4. The method of paragraph 1, 2 or 3, wherein the antibody comprises an IGKC*01 human kappa chain constant region.
5. The method of any one of paragraphs 1 to 4, wherein the human has been determined to comprise the nucleotide sequence that encodes a PCSK9 comprising a C-terminal domain comprising said mutation (eg, I474V or E670G) in SEQ ID NO: 1 and/or a proprotein convertase subtilisin/kexin type 9 (PCSK9) variant protein encoded by the nucleotide sequence of SEQ ID NO: 29 or 30.
6. The method of any one of paragraphs 1 to 5, comprising the step of determining that the human comprises the nucleotide sequence that encodes a PCSK9 comprising a C-terminal domain comprising said mutation (eg, I474V or E670G) and/or a proprotein convertase subtilisin/kexin type 9 (PCSK9) variant protein comprising said mutation (eg, I474V or E670G), optionally, wherein the determining step is performed before administration of the antibody to the human.
7. The method of paragraph 6, wherein the step of determining comprises assaying a biological sample from the human for a nucleotide sequence encoding the PCSK9 that comprises the C-terminal domain comprising the mutation (eg, I474V or E670G) in SEQ ID NO: 1.
8. The method of paragraph 7, wherein the assaying comprises contacting the biological sample with
  a. at least one oligonucleotide probe comprising a sequence of at least 10 contiguous nucleotides that can specifically hybridize to and identify in the biological sample a nucleotide sequence encoding the PCSK9 that comprises the C-terminal domain comprising the mutation (eg, I474V or E670G) in SEQ ID NO: 1 or that specifically hybridizes to an antisense of said sequence, wherein said nucleic acid hybridizes to at least one nucleotide present in said selected sequence which is not present in SEQ ID NO: 28 or hybridizes to an antisense sequence thereby forming a complex when at least one nucleotide sequence encoding the PCSK9 that comprises the C-terminal domain comprising the mutation (eg, I474V or E670G) in SEQ ID NO: 1 is present; and/or
  b. at least one oligonucleotide probe comprising a sequence of at least 10 contiguous nucleotides of a nucleotide sequence encoding the PCSK9 that comprises the C-terminal domain comprising the mutation (eg, I474V or E670G) in SEQ ID NO: 1 or comprising an antisense sequence of said contiguous nucleotides, wherein said sequence of contiguous nucleotides comprises at least one nucleotide present in said selected sequence which is not present in SEQ ID NO: 28 thereby forming a complex when the nucleotide sequence encoding the PCSK9 that comprises a C-terminal domain comprising the mutation (eg, I474V or E670G) in SEQ ID NO: 1 is present; and detecting the presence or absence of the complex, wherein detecting the presence of the complex determines that the human comprises the PCSK9 that comprises the C-terminal domain comprising the mutation (eg, I474V or E670G) in SEQ ID NO: 1.
9. The method of paragraph 7 or 8, wherein the assaying comprises nucleic acid amplification and optionally one or more methods selected from sequencing, next generation sequencing, nucleic acid hybridization, and allele-specific amplification and/or wherein the assaying is performed in a multiplex format.
10. The method of any one of paragraphs 1 to 9, wherein said human is or has been further determined to be substantially resistant to statin treatment.
11. The method of any one of paragraphs 1 to 10, wherein said human is receiving or has received statin treatment or has reduced responsiveness to statin treatment.
12. The method of paragraph 10 or 11, wherein said antibody or antibody fragment is administered to the human separately or simultaneously with said statin treatment.
13. The method of any one of paragraphs 7 to 9, wherein said biological sample comprises serum, blood, feces, tissue, a cell, urine and/or saliva of said human.
14. The method of any one of paragraphs 1 to 13, wherein said human is indicated as heterozygous for a nucleotide sequence encoding the PCSK9 C-terminal domain comprising said mutation (eg, I474V or E670G), optionally, wherein said human is further indicated as comprising the nucleotide sequence of SEQ ID NO: 28, or said human is indicated as homozygous for a nucleotide sequence encoding the PCSK9 C-terminal domain comprising said mutation I474V or E670G in SEQ ID NO: 1.
15. The method of any one of paragraphs 1 to 14, wherein said human has been diagnosed with at least one condition selected from a lipid disorder, hyperlipoproteinemia, hyperlipidemia, dyslipidemia, hypercholesterolemia, a heart attack, a stroke, coronary heart disease, atherosclerosis, peripheral vascular disease, claudication (eg, claudication associated with elevated cholesterol) and high blood pressure.
16. The method of any one of paragraphs 1 to 15, wherein said antibody or antibody fragment treats or reduces the risk in said human of at least one condition selected from a lipid disorder, hyperlipoproteinemia, hyperlipidemia, dyslipidemia, hypercholesterolemia, a heart attack, a stroke, coronary heart disease, atherosclerosis, peripheral vascular disease, claudication (eg, claudication associated with elevated cholesterol) and high blood pressure.
17. The method of any one of paragraphs 1 to 16, wherein the nucleotide sequence is SEQ ID NO: 29 or 30.
18. The method of any one of paragraphs 1 to 17, wherein said antibody or antibody fragment is administered by intravenous or subcutaneous administration and/or is comprised in an injectable preparation.

Further exemplary ligands are in the paragraphs 1-15 as follows.
1. An antibody or antibody fragment for use in a method of (a) reducing cholesterol level or maintaining previously reduced cholesterol level in a human in need thereof or (b) targeting PCSK9 in a human,
  wherein the antibody or fragment comprises a human IGLC2*01 lambda light chain constant region, and the antibody or fragment specifically binds a proprotein convertase subtilisin/kexin type 9 (PCSK9) amino acid sequence that comprises a C-terminal domain comprising a said PCSK9 mutation (eg, I474V or E670G) in SEQ ID NO:1, wherein the human comprises a nucleotide sequence encoding said amino acid sequence and comprises a human IGLC2*01 lambda light chain constant region gene segment, or the human expresses antibodies comprising human IGLC2*01 lambda light chain constant regions.

In an embodiment, said mutation is I474V. In another embodiment, said mutation is E670G.

In an embodiment of (b), the antibody or fragment treats or reduces cholesterol level or maintains previously reduced cholesterol level in the human.

An example provides:—

An antibody or antibody fragment for use in a method of (a) reducing cholesterol level or maintaining previously reduced cholesterol level in a human in need thereof or (b) targeting PCSK9 in a human, wherein the antibody or fragment comprises a human IGLC2*01 lambda light chain constant region, and the antibody or fragment specifically binds a proprotein convertase subtilisin/kexin type 9 (PCSK9) amino acid sequence that comprises a C-terminal domain comprising a mutation I474V in SEQ ID NO:1, wherein the human comprises a nucleotide sequence encoding said amino acid sequence and comprises a human IGLC2*01 lambda light chain constant region gene segment. Optionally, the antibody or fragment comprises a human IGLC2*01 lambda light chain constant region.

In an embodiment of (b), the antibody or fragment treats or reduces cholesterol level or maintains previously reduced cholesterol level in the human.

Another example provides:—

An antibody or antibody fragment for use in a method of (a) reducing cholesterol level or maintaining previously reduced cholesterol level in a human in need thereof or (b) targeting PCSK9 in a human, wherein the antibody or fragment comprises a human IGLC2*01 lambda light chain constant region, and the antibody or fragment specifically binds a proprotein convertase subtilisin/kexin type 9 (PCSK9) amino acid sequence that comprises a C-terminal domain comprising a mutation E670G in SEQ ID NO:1, wherein the human comprises a nucleotide sequence encoding said amino acid sequence and comprises a human IGLC2*01 lambda light chain constant region gene segment. Optionally, the antibody or fragment comprises a human IGLC2*01 lambda light chain constant region.

In an embodiment of (b), the antibody or fragment treats or reduces cholesterol level or maintains previously reduced cholesterol level in the human.

In an example, said antibody or antibody fragment has been determined to specifically bind a proprotein convertase subtilisin/kexin type 9 (PCSK9) that comprises a C-terminal domain comprising a said PCSK9 mutation (eg, I474V or E670G) in SEQ ID NO: 1, wherein the antibody or fragment comprises a human IGLC2*01 lambda light chain constant region and wherein said human comprises (i) an IGLC2*01 human heavy chain constant region gene segment and (ii) a nucleotide sequence encoding said proprotein convertase subtilisin/kexin type 9 (PCSK9) that comprises a C-terminal domain comprising said mutation (eg, I474V or E670G) in SEQ ID NO: 1.

2. The antibody or antibody fragment of paragraph 1, wherein the human has been determined to comprise the nucleotide sequence that encodes a PCSK9 comprising a C-terminal domain comprising said mutation (eg, I474V or E670G) in SEQ ID NO: 1 and/or a proprotein convertase subtilisin/kexin type 9 (PCSK9) variant protein encoded by the nucleotide sequence of SEQ ID NO: 29 or 30.

3. The antibody or antibody fragment of paragraphs 1 or 2, the method comprising the step of determining that the human comprises the nucleotide sequence that encodes a PCSK9 comprising a C-terminal domain comprising said mutation (eg, I474V or E670G) and/or a proprotein convertase subtilisin/kexin type 9 (PCSK9) variant protein comprising said mutation (eg, I474V or E670G), optionally, wherein the determining step is performed before administration of the antibody to the human.

4. The antibody or antibody fragment of paragraph 3, wherein the step of determining comprises assaying a biological sample from the human for a nucleotide sequence encoding the PCSK9 that comprises the C-terminal domain comprising the mutation (eg, I474V or E670G) in SEQ ID NO: 1.

5. The antibody or antibody fragment of paragraph 4, wherein the assaying comprises contacting the biological sample with
   a. at least one oligonucleotide probe comprising a sequence of at least 10 contiguous nucleotides that can specifically hybridize to and identify in the biological sample a nucleotide sequence encoding the PCSK9 that comprises the C-terminal domain comprising the mutation (eg, I474V or E670G) in SEQ ID NO: 1 or that specifically hybridizes to an antisense of said sequence, wherein said nucleic acid hybridizes to at least one nucleotide present in said selected sequence which is not present in SEQ ID NO: 28 or hybridizes to an antisense sequence thereby forming a complex when at least one nucleotide sequence encoding the PCSK9 that comprises the C-terminal domain comprising the mutation (eg, I474V or E670G) in SEQ ID NO: 1 is present; and/or
   b. at least one oligonucleotide probe comprising a sequence of at least 10 contiguous nucleotides of a nucleotide sequence encoding the PCSK9 that comprises the C-terminal domain comprising the mutation (eg, I474V or E670G) in SEQ ID NO: 1 or comprising an antisense sequence of said contiguous nucleotides, wherein said sequence of contiguous nucleotides comprises at least one nucleotide present in said selected sequence which is not present in SEQ ID NO: 28 thereby forming a complex when the nucleotide sequence encoding the PCSK9 that comprises a C-terminal domain comprising the mutation (eg, I474V or E670G) in SEQ ID NO: 1 is present; and
   detecting the presence or absence of the complex, wherein detecting the presence of the complex determines that the human comprises the PCSK9 that comprises the C-terminal domain comprising the mutation (eg, I474V or E670G) in SEQ ID NO: 1.

6. The antibody or antibody fragment of paragraph 4 or 5, wherein the assaying comprises nucleic acid amplification and optionally one or more methods selected from sequencing, next generation sequencing, nucleic acid hybridization, and allele-specific amplification and/or wherein the assaying is performed in a multiplex format.

7. The antibody or antibody fragment of any one of paragraphs 1 to 6, wherein said antibody or antibody fragment is for administration to a human that is or has been further determined to be substantially resistant to statin treatment.

8. The antibody or antibody fragment of any one of paragraphs 1 to 7, wherein antibody or antibody fragment is for administration to a human that is receiving or has received statin treatment or has reduced responsiveness to statin treatment.

9. The antibody or antibody fragment of paragraph 7 or 8, wherein said antibody or antibody fragment is for administration to the human separately or simultaneously with said statin treatment.

10. The antibody or antibody fragment of any one of paragraphs 4 to 8, wherein said biological sample comprises serum, blood, feces, tissue, a cell, urine and/or saliva of said human.
11. The antibody or antibody fragment of any one of paragraphs 1 to 10, wherein said human is indicated as heterozygous for a nucleotide sequence encoding the PCSK9 C-terminal domain comprising a said PCSK9 mutation (eg, I474V or E670G), optionally, wherein said human is further indicated as comprising the nucleotide sequence of SEQ ID NO: 28, or said human is indicated as homozygous for a nucleotide sequence encoding the PCSK9 C-terminal domain comprising a mutation I474V or E670G in SEQ ID NO: 1.
12. The antibody or antibody fragment of any one of paragraphs 1 to 11, wherein said human has been diagnosed with at least one condition selected from a lipid disorder, hyperlipoproteinemia, hyperlipidemia, dyslipidemia, hypercholesterolemia, a heart attack, a stroke, coronary heart disease, atherosclerosis, peripheral vascular disease, claudication (eg, claudication associated with elevated cholesterol) and high blood pressure.
13. The antibody or antibody fragment of any one of paragraphs 1 to 12, wherein said antibody or antibody fragment treats or reduces the risk in said human of at least one condition selected from a lipid disorder, hyperlipoproteinemia, hyperlipidemia, dyslipidemia, hypercholesterolemia, a heart attack, a stroke, coronary heart disease, atherosclerosis, peripheral vascular disease, claudication (eg, claudication associated with elevated cholesterol) and high blood pressure.
14. The antibody or antibody fragment of any one of paragraphs 1 to 13, wherein the nucleotide sequence is SEQ ID NO: 29 or 30.
15. The antibody or antibody fragment of any one of paragraphs 1 to 14, wherein said antibody or antibody fragment is for administration by intravenous or subcutaneous administration and/or is comprised in an injectable preparation.

Further exemplary methods are in the paragraphs 1-16 as follows.
1. A method of reducing cholesterol level or maintaining previously reduced cholesterol level in a human in need thereof, the method comprising administering to said human an antibody or antibody fragment that specifically binds a proprotein convertase subtilisin/kexin type 9 (PCSK9) that comprises a C-terminal domain comprising a said PCSK9 mutation (eg, I474V or E670G) in SEQ ID NO: 1, wherein the antibody or fragment comprises a human IGLC2*01 lambda light chain constant region and wherein said human comprises (i) an IGLC2*01 human light chain constant region gene segment, or the human expresses antibodies comprising a human IGLC2*01 lambda light chain constant regions and (ii) a nucleotide sequence encoding said proprotein convertase subtilisin/kexin type 9 (PCSK9) that comprises a C-terminal domain comprising said mutation (eg, I474V or E670G) in SEQ ID NO: 1.

In an embodiment, said mutation is I474V. In another embodiment, said mutation is E670G.

An example provides:—
A method of reducing cholesterol level or maintaining previously reduced cholesterol level in a human in need thereof, the method comprising administering to said human an antibody or antibody fragment that specifically binds a proprotein convertase subtilisin/kexin type 9 (PCSK9) that comprises a C-terminal domain comprising a mutation I474 in SEQ ID NO: 1, wherein the antibody or fragment comprises a human IGLC2*01 lambda light chain constant region and wherein said human comprises (i) an IGLC2*01 human light chain constant region gene segment and (ii) a nucleotide sequence encoding said proprotein convertase subtilisin/kexin type 9 (PCSK9) that comprises a C-terminal domain comprising said mutation I474V in SEQ ID NO: 1. Optionally, the antibody or fragment comprises an IGLC2*01 human light chain constant region.

Another example provides:—
A method of reducing cholesterol level or maintaining previously reduced cholesterol level in a human in need thereof, the method comprising administering to said human an antibody or antibody fragment that specifically binds a proprotein convertase subtilisin/kexin type 9 (PCSK9) that comprises a C-terminal domain comprising a mutation E670G in SEQ ID NO: 1, wherein the antibody or fragment comprises a human IGLC2*01 lambda light chain constant region and wherein said human comprises (i) an IGLC2*01 human light chain constant region gene segment and (ii) a nucleotide sequence encoding said proprotein convertase subtilisin/kexin type 9 (PCSK9) that comprises a C-terminal domain comprising said mutation E670G in SEQ ID NO: 1. Optionally, the antibody or fragment comprises an IGLC2*01 human light chain constant region.

In an example, said antibody or antibody fragment has been determined to specifically bind a proprotein convertase subtilisin/kexin type 9 (PCSK9) that comprises a C-terminal domain comprising a said PCSK9 mutation (eg, I474V or E670G) in SEQ ID NO: 1, wherein the antibody or fragment comprises a human IGLC2*01 lambda light chain constant region and wherein said human comprises (i) an IGLC2*01 human heavy chain constant region gene segment and (ii) a nucleotide sequence encoding said proprotein convertase subtilisin/kexin type 9 (PCSK9) that comprises a C-terminal domain comprising said mutation (eg, I474V or E670G) in SEQ ID NO: 1

2. The method of paragraph 1, comprising, before said administering, selecting said human comprising said nucleotide sequence of (ii).
3. The method of paragraph 1 or 2, wherein the human has been determined to comprise the nucleotide sequence that encodes a PCSK9 comprising a C-terminal domain comprising said mutation (eg, I474V or E670G) in SEQ ID NO: 1 and/or a proprotein convertase subtilisin/kexin type 9 (PCSK9) variant protein encoded by the nucleotide sequence of SEQ ID NO: 29 or 30.
4. The method of any one of paragraphs 1 to 3, comprising the step of determining that the human comprises the nucleotide sequence that encodes a PCSK9 comprising a C-terminal domain comprising said mutation (eg, I474V or E670G) and/or a proprotein convertase subtilisin/kexin type 9 (PCSK9) variant protein comprising said mutation (eg, I474V or E670G), optionally, wherein the determining step is performed before administration of the antibody to the human.
5. The method of paragraph 4, wherein the step of determining comprises assaying a biological sample from the human for a nucleotide sequence encoding the PCSK9 that comprises the C-terminal domain comprising the mutation (eg, I474V or E670G) in SEQ ID NO: 1.
6. The method of paragraph 5, wherein the assaying comprises contacting the biological sample with
   a. at least one oligonucleotide probe comprising a sequence of at least 10 contiguous nucleotides that can specifically hybridize to and identify in the biological sample a nucleotide sequence encoding the PCSK9 that comprises the C-terminal domain comprising the mutation (eg, I474V or E670G) in SEQ ID NO: 1 or that specifically hybridizes to an antisense of said sequence, wherein said nucleic acid hybridizes to at least one nucleotide present in said selected sequence which is not present in SEQ ID NO: 28 or hybridizes to an antisense sequence thereby forming a complex when at least one nucleotide sequence encoding the PCSK9 that comprises the C-terminal domain comprising the mutation (eg, I474V or E670G) in SEQ ID NO: 1 is present; and/or b. at least one oligonucleotide probe comprising a sequence of at least 10 contiguous nucleotides of a nucleotide sequence encoding the PCSK9 that comprises the C-terminal domain comprising the mutation (eg, I474V or E670G) in SEQ ID NO: 1 or comprising an antisense sequence of said contiguous nucleotides, wherein said sequence of contiguous nucleotides comprises at least one nucleotide present in said selected sequence which is not present in SEQ ID NO: 28 thereby forming a complex when the nucleotide sequence encoding the PCSK9 that comprises a C-terminal domain comprising the mutation (eg, I474V or E670G) in SEQ ID NO: 1 is present; and detecting the presence or absence of the complex, wherein detecting the presence of the complex determines that the human comprises the PCSK9 that comprises the C-terminal domain comprising the mutation (eg, I474V or E670G) in SEQ ID NO: 1.

7. The method of paragraph 5 or 6, wherein the assaying comprises nucleic acid amplification and optionally one or more methods selected from sequencing, next generation sequencing, nucleic acid hybridization, and allele-specific amplification and/or wherein the assaying is performed in a multiplex format.

8. The method of any one of paragraphs 1 to 7, wherein said human is or has been further determined to be substantially resistant to statin treatment.

9. The method of any one of paragraphs 1 to 8, wherein said human is receiving or has received statin treatment or has reduced responsiveness to statin treatment.

10. The method of paragraph 8 or 9, wherein said antibody or antibody fragment is administered to the human separately or simultaneously with said statin treatment.

11. The method of any one of paragraphs 5 to 7, wherein said biological sample comprises serum, blood, feces, tissue, a cell, urine and/or saliva of said human.

12. The method of any one of paragraphs 1 to 11, wherein said human is indicated as heterozygous for a nucleotide sequence encoding the PCSK9 C-terminal domain comprising said mutation (eg, I474V or E670G), optionally, wherein said human is further indicated as comprising the nucleotide sequence of SEQ ID NO: 28, or said human is indicated as homozygous for a nucleotide sequence encoding the PCSK9 C-terminal domain comprising said mutation I474V or E670G in SEQ ID NO: 1.

13. The method of any one of paragraphs 1 to 12, wherein said human has been diagnosed with at least one condition selected from a lipid disorder, hyperlipoproteinemia, hyperlipidemia, dyslipidemia, hypercholesterolemia, a heart attack, a stroke, coronary heart disease, atherosclerosis, peripheral vascular disease, claudication (eg, claudication associated with elevated cholesterol) and high blood pressure.

14. The method of any one of paragraphs 1 to 13, wherein said antibody or antibody fragment treats or reduces the risk in said human of at least one condition selected from a lipid disorder, hyperlipoproteinemia, hyperlipidemia, dyslipidemia, hypercholesterolemia, a heart attack, a stroke, coronary heart disease, atherosclerosis, peripheral vascular disease, claudication (eg, claudication associated with elevated cholesterol) and high blood pressure.

15. The method of any one of paragraphs 1 to 14, wherein the nucleotide sequence is SEQ ID NO: 29 or 30.

16. The method of any one of paragraphs 1 to 15, wherein said antibody or antibody fragment is administered by intravenous or subcutaneous administration and/or is comprised in an injectable preparation.

Further exemplary ligands are in the paragraphs 1-15 as follows.

1. An antibody or antibody fragment for use in a method of (a) reducing cholesterol level or maintaining previously reduced cholesterol level in a human in need thereof or (b) targeting PCSK9 in a human, wherein the antibody or fragment comprises a human variable domain that is derived from the recombination of a human VH gene segment, a human D gene segment and a human JH gene segment, wherein the VH gene segment is as defined in any one of clauses 80 to 90, and the antibody or fragment specifically binds a proprotein convertase subtilisin/kexin type 9 (PCSK9) amino acid sequence that comprises a C-terminal domain comprising a said PCSK9 mutation (eg, I474V or E670G) in SEQ ID NO:1, wherein the human comprises a nucleotide sequence encoding said amino acid sequence, and comprises said VH gene segment or expresses antibodies comprising VH domains that are derived from the recombination of said human VH gene segment, a human D gene segment and a human JH gene segment.

In an embodiment, said mutation is I474V. In another embodiment, said mutation is E670G.

In an embodiment of (b), the antibody or fragment treats or reduces cholesterol level or maintains previously reduced cholesterol level in the human.

2. The antibody or antibody fragment of paragraph 1, wherein the human has been determined to comprise the nucleotide sequence that encodes a PCSK9 comprising a C-terminal domain comprising said mutation (eg, I474V or E670G) in SEQ ID NO: 1 and/or a proprotein convertase subtilisin/kexin type 9 (PCSK9) variant protein encoded by the nucleotide sequence of SEQ ID NO: 29 or 30.

3. The antibody or antibody fragment of paragraphs 1 or 2, the method comprising the step of determining that the human comprises the nucleotide sequence that encodes a PCSK9 comprising a C-terminal domain comprising said mutation (eg, I474V or E670G) and/or a proprotein convertase subtilisin/kexin type 9 (PCSK9) variant protein comprising said mutation (eg, I474V or E670G), optionally, wherein the determining step is performed before administration of the antibody to the human.

4. The antibody or antibody fragment of paragraph 3, wherein the step of determining comprises assaying a biological sample from the human for a nucleotide sequence encoding the PCSK9 that comprises the C-terminal domain comprising the mutation (eg, I474V or E670G) in SEQ ID NO: 1.

5. The antibody or antibody fragment of paragraph 4, wherein the assaying comprises contacting the biological sample with
 a. at least one oligonucleotide probe comprising a sequence of at least 10 contiguous nucleotides that can specifically hybridize to and identify in the biological sample a nucleotide sequence encoding the PCSK9 that comprises the C-terminal domain comprising the mutation (eg, I474V or E670G) in SEQ ID NO: 1 or that specifically hybridizes to an antisense of said sequence, wherein said nucleic acid hybridizes to at least one nucleotide present in said selected sequence which is not present in SEQ ID NO: 28 or hybridizes to an antisense sequence thereby forming a complex when at least one nucleotide sequence encoding the PCSK9 that comprises the C-terminal domain comprising the mutation (eg, I474V or E670G) in SEQ ID NO: 1 is present; and/or b. at least one oligonucleotide probe comprising a sequence of at least 10 contiguous nucleotides of a nucleotide sequence encoding the PCSK9 that comprises the C-terminal domain comprising the mutation (eg, I474V or E670G) in SEQ ID NO: 1 or comprising an antisense sequence of said contiguous nucleotides, wherein said sequence of contiguous nucleotides comprises at least one nucleotide present in said selected sequence which is not present in SEQ ID NO: 28 thereby forming a complex when the nucleotide sequence encoding the PCSK9 that comprises a C-terminal domain comprising the mutation (eg, I474V or E670G) in SEQ ID NO: 1 is present; and detecting the presence or absence of the complex, wherein detecting the presence of the complex determines that the human comprises the PCSK9 that comprises the C-terminal domain comprising the mutation (eg, I474V or E670G) in SEQ ID NO: 1.

6. The antibody or antibody fragment of paragraph 4 or 5, wherein the assaying comprises nucleic acid amplification and optionally one or more methods selected from sequencing, next generation sequencing, nucleic acid hybridization, and allele-specific amplification and/or wherein the assaying is performed in a multiplex format.

7. The antibody or antibody fragment of any one of paragraphs 1 to 6, wherein said antibody or antibody fragment is for administration to a human that is or has been further determined to be substantially resistant to statin treatment.

8. The antibody or antibody fragment of any one of paragraphs 1 to 7, wherein antibody or antibody fragment is for administration to a human that is receiving or has received statin treatment or has reduced responsiveness to statin treatment.

9. The antibody or antibody fragment of paragraph 7 or 8, wherein said antibody or antibody fragment is for administration to the human separately or simultaneously with said statin treatment.

10. The antibody or antibody fragment of any one of paragraphs 4 to 8, wherein said biological sample comprises serum, blood, feces, tissue, a cell, urine and/or saliva of said human.

11. The antibody or antibody fragment of any one of paragraphs 1 to 10, wherein said human is indicated as heterozygous for a nucleotide sequence encoding the PCSK9 C-terminal domain comprising a said PCSK9 mutation (eg, I474V or E670G), optionally, wherein said human is further indicated as comprising the nucleotide sequence of SEQ ID NO: 28, or said human is indicated as homozygous for a nucleotide sequence encoding the PCSK9 C-terminal domain comprising a mutation I474V or E670G in SEQ ID NO: 1.

12. The antibody or antibody fragment of any one of paragraphs 1 to 11, wherein said human has been diagnosed with at least one condition selected from a lipid disorder, hyperlipoproteinemia, hyperlipidemia, dyslipidemia, hypercholesterolemia, a heart attack, a stroke, coronary heart disease, atherosclerosis, peripheral vascular disease, claudication (eg, claudication associated with elevated cholesterol) and high blood pressure.

13. The antibody or antibody fragment of any one of paragraphs 1 to 12, wherein said antibody or antibody fragment treats or reduces the risk in said human of at least one condition selected from a lipid disorder, hyperlipoproteinemia, hyperlipidemia, dyslipidemia, hypercholesterolemia, a heart attack, a stroke, coronary heart disease, atherosclerosis, peripheral vascular disease, claudication (eg, claudication associated with elevated cholesterol) and high blood pressure.

14. The antibody or antibody fragment of any one of paragraphs 1 to 13, wherein the nucleotide sequence is SEQ ID NO: 29 or 30.

15. The antibody or antibody fragment of any one of paragraphs 1 to 14, wherein said antibody or antibody fragment is for administration by intravenous or subcutaneous administration and/or is comprised in an injectable preparation.

Further exemplary methods are in the paragraphs 1-16 as follows.

1. A method of (a) reducing cholesterol level or maintaining previously reduced cholesterol level in a human in need thereof or (b) targeting PCSK9 in a human,
the method comprising administering to said human an antibody or antibody fragment that specifically binds a proprotein convertase subtilisin/kexin type 9 (PCSK9) that comprises a C-terminal domain comprising a said PCSK9 mutation (eg, I474V or E670G) in SEQ ID NO: 1, wherein the antibody or fragment comprises a human variable domain that is derived from the recombination of a human VH gene segment, a human D gene segment and a human JH gene segment, wherein the VH gene segment is as defined in any one of clauses 80 to 90 and wherein said human comprises (i) comprises said VH gene segment or expresses antibodies comprising VH domains that are derived from the recombination of said human VH gene segment, a human D gene segment and a human JH gene segment and (ii) a nucleotide sequence encoding said proprotein convertase subtilisin/kexin type 9 (PCSK9) that comprises a C-terminal domain comprising said mutation (eg, I474V or E670G) in SEQ ID NO: 1.

In an embodiment, said mutation is I474V. In another embodiment, said mutation is E670G.

In an embodiment of (b), the antibody or fragment treats or reduces cholesterol level or maintains previously reduced cholesterol level in the human.

2. The method of paragraph 1, comprising, before said administering, selecting said human comprising said nucleotide sequence of (ii).

3. The method of paragraph 1 or 2, wherein the human has been determined to comprise the nucleotide sequence that encodes a PCSK9 comprising a C-terminal domain comprising said mutation (eg, I474V or E670G) in SEQ ID NO: 1 and/or a proprotein convertase subtilisin/kexin type 9 (PCSK9) variant protein encoded by the nucleotide sequence of SEQ ID NO: 29 or 30.

4. The method of any one of paragraphs 1 to 3, comprising the step of determining that the human comprises the nucleotide sequence that encodes a PCSK9 comprising a C-terminal domain comprising said mutation (eg, I474V or E670G) and/or a proprotein convertase subtilisin/kexin type 9 (PCSK9) variant protein comprising said mutation (eg, I474V or E670G), optionally, wherein the determining step is performed before administration of the antibody to the human.

5. The method of paragraph 4, wherein the step of determining comprises assaying a biological sample from the human for a nucleotide sequence encoding the PCSK9 that comprises the C-terminal domain comprising the mutation (eg, I474V or E670G) in SEQ ID NO: 1.
6. The method of paragraph 5, wherein the assaying comprises contacting the biological sample with
   a. at least one oligonucleotide probe comprising a sequence of at least 10 contiguous nucleotides that can specifically hybridize to and identify in the biological sample a nucleotide sequence encoding the PCSK9 that comprises the C-terminal domain comprising the mutation (eg, I474V or E670G) in SEQ ID NO: 1 or that specifically hybridizes to an antisense of said sequence, wherein said nucleic acid hybridizes to at least one nucleotide present in said selected sequence which is not present in SEQ ID NO: 28 or hybridizes to an antisense sequence thereby forming a complex when at least one nucleotide sequence encoding the PCSK9 that comprises the C-terminal domain comprising the mutation (eg, I474V or E670G) in SEQ ID NO: 1 is present; and/or
   b. at least one oligonucleotide probe comprising a sequence of at least 10 contiguous nucleotides of a nucleotide sequence encoding the PCSK9 that comprises the C-terminal domain comprising the mutation (eg, I474V or E670G) in SEQ ID NO: 1 or comprising an antisense sequence of said contiguous nucleotides, wherein said sequence of contiguous nucleotides comprises at least one nucleotide present in said selected sequence which is not present in SEQ ID NO: 28 thereby forming a complex when the nucleotide sequence encoding the PCSK9 that comprises a C-terminal domain comprising the mutation (eg, I474V or E670G) in SEQ ID NO: 1 is present; and detecting the presence or absence of the complex, wherein detecting the presence of the complex determines that the human comprises the PCSK9 that comprises the C-terminal domain comprising the mutation (eg, I474V or E670G) in SEQ ID NO: 1.
7. The method of paragraph 5 or 6, wherein the assaying comprises nucleic acid amplification and optionally one or more methods selected from sequencing, next generation sequencing, nucleic acid hybridization, and allele-specific amplification and/or wherein the assaying is performed in a multiplex format.
8. The method of any one of paragraphs 1 to 7, wherein said human is or has been further determined to be substantially resistant to statin treatment.
9. The method of any one of paragraphs 1 to 8, wherein said human is receiving or has received statin treatment or has reduced responsiveness to statin treatment.
10. The method of paragraph 8 or 9, wherein said antibody or antibody fragment is administered to the human separately or simultaneously with said statin treatment.
11. The method of any one of paragraphs 5 to 7, wherein said biological sample comprises serum, blood, feces, tissue, a cell, urine and/or saliva of said human.
12. The method of any one of paragraphs 1 to 11, wherein said human is indicated as heterozygous for a nucleotide sequence encoding the PCSK9 C-terminal domain comprising said mutation (eg, I474V or E670G), optionally, wherein said human is further indicated as comprising the nucleotide sequence of SEQ ID NO: 28, or said human is indicated as homozygous for a nucleotide sequence encoding the PCSK9 C-terminal domain comprising said mutation I474V or E670G in SEQ ID NO: 1.
13. The method of any one of paragraphs 1 to 12, wherein said human has been diagnosed with at least one condition selected from a lipid disorder, hyperlipoproteinemia, hyperlipidemia, dyslipidemia, hypercholesterolemia, a heart attack, a stroke, coronary heart disease, atherosclerosis, peripheral vascular disease, claudication (eg, claudication associated with elevated cholesterol) and high blood pressure.
14. The method of any one of paragraphs 1 to 13, wherein said antibody or antibody fragment treats or reduces the risk in said human of at least one condition selected from a lipid disorder, hyperlipoproteinemia, hyperlipidemia, dyslipidemia, hypercholesterolemia, a heart attack, a stroke, coronary heart disease, atherosclerosis, peripheral vascular disease, claudication (eg, claudication associated with elevated cholesterol) and high blood pressure.
15. The method of any one of paragraphs 1 to 14, wherein the nucleotide sequence is SEQ ID NO: 29 or 30.
16. The method of any one of paragraphs 1 to 15, wherein said antibody or antibody fragment is administered by intravenous or subcutaneous administration and/or is comprised in an injectable preparation.

In an alternative, instead of being a method "of reducing cholesterol level or maintaining previously reduced cholesterol level" as recited herein the method is "of treating and/or preventing a human PCSK9-mediated condition or disease" (eg, associated with hyper- or hypocholesterolemia or any other PCSK9-mediated disease or condition disclosed herein) and the mutation is instead selected from the group of R46L, A53V, N425S, A443T, I474V, Q619P and E670G. Hence in this alternative, any such embodiment is disclosed as written herein but with the mutation recited as selected from this group. In an example, the mutation is R46L. In an example, the mutation is A53V. In an example, the mutation is N425S. In an example, the mutation is A443T. In an example, the mutation is I474V. In an example, the mutation is Q619P. In an example, the mutation is E670G.

Regimens

A: The invention further provides the following regimens, ligands and kits.

1. A method for treating a human PCSK9-mediated disease or condition in a human by targeting a rare variant human PCSK9, the method comprising administering to the human a ligand (eg, an antibody or fragment) that has been determined to specifically bind to said PCSK9variant; wherein the human expresses said PCSK9 variant or the genome of the human comprises a nucleotide sequence encoding said PCSK9 variant; wherein said human is treated for said disease or condition.

In an alternative, clause 1 provides:—

A method for targeting a rare variant human PCSK9, the method comprising administering to the human a ligand (eg, an antibody or fragment) that has been determined to specifically bind to said PCSK9variant; wherein the human expresses said PCSK9 variant or the genome of the human comprises a nucleotide sequence encoding said PCSK9 variant. In an embodiment, said human is treated for said disease or condition.

The variant PCSK9 can, for example, be any rare variant as described herein.

For example, there is provided:

1a. A method for treating a PCSK9-mediated disease or condition in a human by targeting a PCSK9 that comprises a C-terminal domain amino acid polymorphism (compared to SEQ ID NO: 1), the method comprising administering to the human a ligand (eg, an antibody or fragment) that has been determined to specifically bind to a PCSK9 comprising a C-terminal domain comprising a said PCSK9 mutation (eg, I474V or 670G) (numbering according to SEQ ID NO:1); wherein the human expresses said PCSK9 or the genome of the human comprises a nucleotide sequence encoding said PCSK9; wherein said human is treated for said disease or condition.

For example, there is provided:

1b. A method for targeting a PCSK9 that comprises a C-terminal domain amino acid polymorphism (compared to SEQ ID NO: 1), the method comprising administering to the human a ligand (eg, an antibody or fragment) that has been determined to specifically bind to a PCSK9 comprising a C-terminal domain comprising a said PCSK9 mutation (eg, I474V or 670G) (numbering according to SEQ ID NO:1); wherein the human expresses said PCSK9 or the genome of the human comprises a nucleotide sequence encoding said PCSK9; optionally wherein said human is treated for said disease or condition.

In an embodiment, determination of said specific binding is by reference to binding assay data, eg, as determined using SPR or ELISA. Determination may, for example, be by reference to information in a printed publication, eg, with knowledge of data presented in the present or another patent application or in a journal article. Once armed with such knowledge (eg, in the absence of further testing of binding), the skilled person is able—by direction of the present invention—to treat a relevant human whose genotype or phenotype matches the binding specificity of the ligand.

The antibody or fragment can be according to any configuration, example, embodiment, aspect, clause or paragraph herein.

In an embodiment, the method comprises, before said administering, selecting a human comprising said nucleotide sequence encoding the PCSK9, wherein the human is said human in clause 1 (eg, 1a).

2. The method of clause 1, comprising before said administering the step of determining that the ligand specifically binds to said PCSK9, eg, using SPR or ELISA.
3. The method of clause 1 or 2, wherein the specific binding to said PCSK9 is binding with a dissociation constant (Kd) of 1 nM or less, eg, 100, 10 or 1 pM or less.
4. The method of any of clauses 1 to 3 (eg, clause 1a), wherein the condition is elevated LDL-cholesterol or is caused by elevated LDL-cholesterol.
5. The method of clause 4 (eg, when dependent from clause 1a), wherein the condition is selected from a lipid disorder, hyperlipoproteinemia, hyperlipidemia, dyslipidemia, hypercholesterolemia, a heart attack, a stroke, coronary heart disease, atherosclerosis, peripheral vascular disease, claudication (eg, claudication associated with elevated cholesterol) and high blood pressure.
6. The method of any one of clauses 1 to 5 (eg, when dependent from clause 1a), wherein the human has been determined to comprise the nucleotide sequence that encodes a PCSK9 comprising a C-terminal domain comprising said mutation (eg, I474V or E670G) in SEQ ID NO: 1 and/or a proprotein convertase subtilisin/kexin type 9 (PCSK9) variant protein encoded by the nucleotide sequence of SEQ ID NO: 29 or 30.
7. The method of any one of clauses 1 to 6 (eg, when dependent from clause 1a), comprising the step of determining that the human comprises the nucleotide sequence that encodes a PCSK9 comprising a C-terminal domain comprising said mutation (eg, I474V or E670G) and/or a proprotein convertase subtilisin/kexin type 9 (PCSK9) variant protein comprising said mutation (eg, I474V or E670G), optionally, wherein the determining step is performed before administration of the antibody to the human.
8. The method of clause 7, wherein the step of determining comprises assaying a biological sample from the human for a nucleotide sequence encoding the PCSK9 that comprises the C-terminal domain comprising the mutation (eg, I474V or E670G) in SEQ ID NO: 1.
9. The method of clause 8, wherein the assaying comprises contacting the biological sample with
   a. at least one oligonucleotide probe comprising a sequence of at least 10 contiguous nucleotides that can specifically hybridize to and identify in the biological sample a nucleotide sequence encoding the PCSK9 that comprises the C-terminal domain comprising the mutation (eg, I474V or E670G) in SEQ ID NO: 1 or that specifically hybridizes to an antisense of said sequence, wherein said nucleic acid hybridizes to at least one nucleotide present in said selected sequence which is not present in SEQ ID NO: 28 or hybridizes to an antisense sequence thereby forming a complex when at least one nucleotide sequence encoding the PCSK9 that comprises the C-terminal domain comprising the mutation (eg, I474V or E670G) in SEQ ID NO: 1 is present; and/or
   b. at least one oligonucleotide probe comprising a sequence of at least 10 contiguous nucleotides of a nucleotide sequence encoding the PCSK9 that comprises the C-terminal domain comprising the mutation (eg, I474V or E670G) in SEQ ID NO: 1 or comprising an antisense sequence of said contiguous nucleotides, wherein said sequence of contiguous nucleotides comprises at least one nucleotide present in said selected sequence which is not present in SEQ ID NO: 28 thereby forming a complex when the nucleotide sequence encoding the PCSK9 that comprises a C-terminal domain comprising the mutation (eg, I474V or E670G) in SEQ ID NO: 1 is present; and detecting the presence or absence of the complex, wherein detecting the presence of the complex determines that the human comprises the PCSK9 that comprises the C-terminal domain comprising the mutation (eg, I474V or E670G) in SEQ ID NO: 1.
10. The method of clause 8 or 9, wherein the assaying comprises nucleic acid amplification and optionally one or more methods selected from sequencing, next generation sequencing, nucleic acid hybridization, and allele-specific amplification and/or wherein the assaying is performed in a multiplex format.
11. The method of any one of clauses 1 to 10, wherein said human is or has been further determined to be substantially resistant to statin treatment.
12. The method of any one of clauses 1 to 11, wherein said human is receiving or has received statin treatment or has reduced responsiveness to statin treatment.
13. The method of clauses 11 or 12, wherein said antibody or antibody fragment is administered to the human separately or simultaneously with said statin treatment.
14. The method of any one of clauses 8 to 10, wherein said biological sample comprises serum, blood, feces, tissue, a cell, urine and/or saliva of said human.
15. The method of any one of clauses 1 to 14, wherein said human is indicated as heterozygous for a nucleotide sequence encoding the PCSK9 C-terminal domain comprising said mutation (eg, I474V or E670G), optionally, wherein said human is further indicated as comprising the nucleotide sequence of SEQ ID NO: 28, or said human is indicated as homozygous for a nucleotide sequence encoding the PCSK9 C-terminal domain comprising said mutation I474V or E670G in SEQ ID NO: 1.

16. The method of any one of clauses 1 to 15, wherein said human has been diagnosed with at least one condition selected from a lipid disorder, hyperlipoproteinemia, hyperlipidemia, dyslipidemia, hypercholesterolemia, a heart attack, a stroke, coronary heart disease, atherosclerosis, peripheral vascular disease, claudication (eg, claudication associated with elevated cholesterol) and high blood pressure.

17. The method of any one of clauses 1 to 16, wherein said antibody or antibody fragment treats or reduces the risk in said human of at least one condition selected from a lipid disorder, hyperlipoproteinemia, hyperlipidemia, dyslipidemia, hypercholesterolemia, a heart attack, a stroke, coronary heart disease, atherosclerosis, peripheral vascular disease, claudication (eg, claudication associated with elevated cholesterol) and high blood pressure.

18. The method of any one of clauses 1 to 17, wherein the nucleotide sequence is SEQ ID NO: 29 or 30.

19. The method of any one of clauses 1 to 18, wherein said antibody or antibody fragment is administered by intravenous or subcutaneous administration and/or is comprised in an injectable preparation.

20. A ligand (eg, an antibody or fragment) for use in the method of any one of clauses 1 to 19, wherein the ligand specifically binds the PCSK9.

21. A kit comprising the ligand of clause 20 and instructions for carrying out the method of any one of clauses 1 to 19.

B: The invention further provides the following regimens, ligands and kits.

1. A method of reducing cholesterol level or maintaining a previously reduced cholesterol level in a human in need thereof, the method comprising:—
   a. Carrying out an initial treatment of said human for an initial treatment period by administering an anti-human PCSK9 ligand (eg, an antibody or fragment) to said human, wherein (i) the ligand has been determined to specifically bind to a PCSK9 comprising a C-terminal domain comprising a said PCSK9 mutation (eg, I474V or 670G) (numbering according to SEQ ID NO:1); (ii) the human expresses said PCSK9 or the genome of the human comprises a nucleotide sequence encoding said PCSK9 and (iii) the human has received or is receiving statin treatment to lower or maintain cholesterol level; wherein the initial treatment comprises the administration of a single or multiple doses of the ligand to the human;
   b. Determining to (i) terminate statin treatment (ii) keep the human off statin treatment; or (iii) reduce statin treatment after said initial treatment period; and
   c. Continuing to administer the ligand to said patient after said time period has expired, thereby reducing cholesterol level or maintaining a previously reduced cholesterol level in said human.

In an embodiment, determination of said specific binding is by reference to binding assay data, eg, as determined using SPR or ELISA. Determination may, for example, be by reference to information in a printed publication, eg, with knowledge of data presented in the present or another patent application or in a journal article. Once armed with such knowledge (eg, in the absence of further testing of binding), the skilled person is able—by direction of the present invention—to treat a relevant human whose genotype or phenotype matches the binding specificity of the ligand.

The antibody or fragment can be according to any configuration, example, embodiment, aspect, clause or paragraph herein.

A pharmaceutically-effective amount of said ligand is administered.

In an embodiment, the method comprises, before said administering, selecting a human comprising said nucleotide sequence encoding the PCSK9, wherein the human is said human recited in clause 1.

In an example, the initial treatment period is 7 days, 14 days, 21 days, 28 days, a month, two months, three months, four months, five months, six months, seven months, eight months, nine months or a year.

2. The method of clause 1, wherein the human has or is suffering from statin-associated memory loss or a statin-associated neurodegenerative condition, or has or is at increased risk of diabetes (eg, statin-associated diabetes).

3. The method of clause 1 or 2, comprising, before said initial treatment, the step of determining that the human has or is suffering from statin-associated memory loss or a statin-associated neurodegenerative condition, or has or is at increased risk of diabetes (eg, statin-associated diabetes).

4. The method of clause 2 or 3, comprising, after step (b) (eg, during step (c)) determining that the memory loss or said neurodegenerative condition has improved.

5. The method of any one of clauses 1 to 4, wherein said human is over 40 years of age (eg, 50 or over, 55 or over, 60 or over, 65 or over, or 70 or over).

6. The method of any one of clauses 1 to 5, wherein step (c) comprises determining to increase the doses of said ligand to be administered after said initial treatment period and administering said increased doses to said human.

7. The method of any one of clauses 1 to 6, wherein step (b) comprises determining that the human is intolerant or refactory to treatment by a statin.

8. The method of any one of clauses 1 to 7, wherein the initial treatment comprises the administration of a statin, fenofibrate (eg, Tricor™ or Lofibra™) or ezetimibe to the human in addition to the ligand.

9. The method of any one of clauses 1 to 8, wherein step (b) comprises terminating or reducing statin, fenofibrate (eg, Tricor™ or Lofibra™) or ezetimibe treatment during step (c).

10. The method of any one of clauses 1 to 9, comprising increasing (ie, increasing compared to the initial treatment dose) the ligand dose during step (c).

11. The method of any one of clauses 1 to 10, wherein the human has received high dose statin treatment prior to the initial treatment, and wherein step (c) comprises administering a lower (eg, a medium or low) dose statin treatment in addition to said ligand.

The skilled person is familiar with the meaning of high, medium and low dose treatments (and how to determine according to each patient, eg, the patient's body mass). For example, the statin is selected from rosuvastatin, atorvastatin and simvastatin.

For example daily statin doses are as follows:—Low 10 to 20 mg (eg, 10 mg); medium >20 and <60 mg (eg, 40 mg); high 60-100 mg (eg, 80 mg).

12. The method of any one of clauses 1 to 10, wherein the human has received medium dose statin treatment prior to the initial treatment, and wherein step (c) comprises administering a lower (eg, a low) dose statin treatment or no statin in addition to said ligand.

13. The method of any one of clauses 1 to 10, wherein the human has received low dose statin treatment prior to the initial treatment, and wherein step (c) comprises administering no statin in addition to said ligand.
14. The method of any one of clauses 1 to 13, comprising, before the initial treatment, the step of determining that the ligand specifically binds to said PCSK9, eg, using SPR or ELISA.
15. The method of any one of clauses 1 to 14, wherein the specific binding to said PCSK9 is binding with a dissociation constant (Kd) of 1 nM or less, eg, 100, 10 or 1 pM or less.
16. The method of any of clauses 1 to 15, wherein the human is at risk of or suffering from a condition selected from a lipid disorder, hyperlipoproteinemia, hyperlipidemia, dyslipidemia, hypercholesterolemia, a heart attack, a stroke, coronary heart disease, atherosclerosis, peripheral vascular disease, claudication (eg, claudication associated with elevated cholesterol) and high blood pressure.
17. The method of clause 16, wherein step (c) treats or reduces the risk of said condition in the human.
18. The method of any one of clauses 1 to 17, wherein the human has been determined to comprise the nucleotide sequence that encodes a PCSK9 comprising a C-terminal domain comprising said mutation (eg, I474V or E670G) in SEQ ID NO: 1 and/or a proprotein convertase subtilisin/kexin type 9 (PCSK9) variant protein encoded by the nucleotide sequence of SEQ ID NO: 29 or 30.
19. The method of any one of clauses 1 to 18, comprising the step of determining that the human comprises the nucleotide sequence that encodes a PCSK9 comprising a C-terminal domain comprising said mutation (eg, I474V or E670G) and/or a proprotein convertase subtilisin/kexin type 9 (PCSK9) variant protein comprising said mutation (eg, I474V or E670G), optionally, wherein the determining step is performed before administration of the antibody to the human.
20. The method of clause 19, wherein the step of determining comprises assaying a biological sample from the human for a nucleotide sequence encoding the PCSK9 that comprises the C-terminal domain comprising the mutation (eg, I474V or E670G) in SEQ ID NO: 1.
21. The method of clause 20, wherein the assaying comprises contacting the biological sample with
  a. at least one oligonucleotide probe comprising a sequence of at least 10 contiguous nucleotides that can specifically hybridize to and identify in the biological sample a nucleotide sequence encoding the PCSK9 that comprises the C-terminal domain comprising the mutation (eg, I474V or E670G) in SEQ ID NO: 1 or that specifically hybridizes to an antisense of said sequence, wherein said nucleic acid hybridizes to at least one nucleotide present in said selected sequence which is not present in SEQ ID NO: 28 or hybridizes to an antisense sequence thereby forming a complex when at least one nucleotide sequence encoding the PCSK9 that comprises the C-terminal domain comprising the mutation (eg, I474V or E670G) in SEQ ID NO: 1 is present; and/or
  b. at least one oligonucleotide probe comprising a sequence of at least 10 contiguous nucleotides of a nucleotide sequence encoding the PCSK9 that comprises the C-terminal domain comprising the mutation (eg, I474V or E670G) in SEQ ID NO: 1 or comprising an antisense sequence of said contiguous nucleotides, wherein said sequence of contiguous nucleotides comprises at least one nucleotide present in said selected sequence which is not present in SEQ ID NO: 28 thereby forming a complex when the nucleotide sequence encoding the PCSK9 that comprises a C-terminal domain comprising the mutation (eg, I474V or E670G) in SEQ ID NO: 1 is present; and detecting the presence or absence of the complex, wherein detecting the presence of the complex determines that the human comprises the PCSK9 that comprises the C-terminal domain comprising the mutation (eg, I474V or E670G) in SEQ ID NO: 1.
22. The method of clause 20 or 21, wherein the assaying comprises nucleic acid amplification and optionally one or more methods selected from sequencing, next generation sequencing, nucleic acid hybridization, and allele-specific amplification and/or wherein the assaying is performed in a multiplex format.
23. The method of any one of clauses 1 to 22, wherein said human is or has been further determined to be substantially resistant to statin treatment.
24. The method of any one of clauses 20 to 22, wherein said biological sample comprises serum, blood, feces, tissue, a cell, urine and/or saliva of said human.
25. The method of any one of clauses 1 to 24, wherein said human is indicated as heterozygous for a nucleotide sequence encoding the PCSK9 C-terminal domain comprising said mutation (eg, I474V or E670G), optionally, wherein said human is further indicated as comprising the nucleotide sequence of SEQ ID NO: 28, or said human is indicated as homozygous for a nucleotide sequence encoding the PCSK9 C-terminal domain comprising said mutation I474V or E670G in SEQ ID NO: 1.
26. The method of any one of clauses 1 to 25, wherein said human has been diagnosed with at least one condition selected from a lipid disorder, hyperlipoproteinemia, hyperlipidemia, dyslipidemia, hypercholesterolemia, a heart attack, a stroke, coronary heart disease, atherosclerosis, peripheral vascular disease, claudication (eg, claudication associated with elevated cholesterol) and high blood pressure.
27. The method of any one of clauses 1 to 26, wherein the nucleotide sequence is SEQ ID NO: 29 or 30.
28. The method of any one of clauses 1 to 27, wherein said ligand (eg, antibody or antibody fragment) is administered by intravenous or subcutaneous administration and/or is comprised in an injectable preparation.
29. A ligand (eg, an antibody or fragment) for use in the method of any one of clauses 1 to 28, wherein the ligand specifically binds the PCSK9.
30. A kit comprising the ligand of clause 29 and instructions for carrying out the method of any one of clauses 1 to 28.

In an example of any aspect of the invention, the ligand (eg, antibody or fragment, eg, alirocumab, bocovizumab or evolocumab, or an antibody or fragment comprising the variable domains of 316P or 31H4) is administered to the human at a two-weekly dose of from 75 to 150 mg (eg, from 75 to 150 mg administered once or twice over a two-week period). In an example, the ligand is for such administration to the human.

Determination of Specific Binding of Ligands of the Invention to PCSK9 Variants

Method of SPR Determination of Binding

Binding of the antibodies to the PCSK9 variants was carried out by SPR using the ProteOn XPR36™ Array system (BioRad). An anti-human IgG surface (Jackson Labs 109-005-008) was created on a GLC Biosensor chip by primary amine coupling. Test antibodies were captured on this surface as ligands. The PCSK9 variants were used as analytes and passed over the captured antibodies at 256 nM, 64 nM, 16 nM, 4 nM and 1 nM. Binding curves were double referenced using a buffer injection (i.e. 0 nM) to remove baseline drift and injection artefacts. Regeneration of the capture surface was with 100 mM phosphoric acid which removed the captured antibody allowing another cycle of capture and binding. The binding sensorgrams generated were analysed using the 1:1 model inherent to the ProteOn XPR36 Array system analysis software. The assay was performed at 25° C. and using 1xHBS-EP (Teknova) as running buffer.

Data

Three antibodies were tested and the resulting binding data are presented below (Table 3). Antibodies 316P and 31H4 are antibodies disclosed in US20110065902A1 (the sequences of these antibodies and their variable domains are incorporated herein by reference for possible use in the present invention and possible inclusion in claims herein). Antibody 316P comprises heavy chain variable domains derived from recombination of human VH3-23*04 and JH2*01 (with a D), and light chain variable domains derived from recombination of human Vκ4-1*01 and R2*01.

Evolocumab comprises a human IGHG2*01 heavy chain and a human IGLC2*01 lambda light chain, a VH derived from recombination of human IGHV1-18*01 and IGHJ6*01 (with a D segment) and a Vλ derived from recombination of human IGLV2-14*01 and IGLJ2*01.

TABLE 3

SPR Determination of Ligand Binding Specificity for PCSK9 Variants

| Variant/Antibody | ka (1/Ms) | kd (1/s) | KD (nM) |
|---|---|---|---|
| PCSK9 a | | | |
| 316P | 1.37E+06 | 2.75E−04 | 0.201 |
| 31H4 | 1.14E+06 | 6.38E−05 | 0.056 |
| Evolocumab | 1.14E+05 | 2.62E−05 | 0.229 |
| PCSK9 a' | | | |
| 316P | 1.50E+06 | 2.72E−04 | 0.181 |
| 31H4 | 1.23E+06 | 6.06E−05 | 0.049 |
| Evolocumab | 1.24E+05 | 2.29E−05 | 0.185 |
| PCSK9 c | | | |
| 316P | 1.49E+06 | 2.75E−04 | 0.184 |
| 31H4 | 1.22E+06 | 5.69E−05 | 0.047 |
| Evolocumab | 1.20E+05 | 2.20E−05 | 0.183 |
| PCSK9 r | | | |
| 316P | 1.40E+06 | 2.76E−04 | 0.197 |
| 31H4 | 1.15E+06 | 5.82E−05 | 0.051 |
| Evolocumab | 1.16E+05 | 2.67E−05 | 0.230 |
| PCSK9 f | | | |
| 316P | 1.39E+06 | 2.82E−04 | 0.203 |
| 31H4 | 1.13E+06 | 5.95E−05 | 0.053 |
| Evolocumab | 1.16E+05 | 2.66E−05 | 0.229 |
| PCSK9 p | | | |
| 316P | 1.39E+06 | 2.73E−04 | 0.196 |
| 31H4 | 1.14E+06 | 6.12E−05 | 0.054 |
| Evolocumab | 1.14E+05 | 2.50E−05 | 0.219 |

Results

The results showed that all antibodies tested bound to PCSK9 variants equally, with any binding variation seen being within experimental error for such a strong affinity interaction.

Thus, the invention determines that an antibody with the following profile can specifically bind one or more variants of the invention:—

1. An antibody (eg, 316P or alirocumab) that comprises heavy chain variable domains derived from recombination of human IGHV3-23*04 and IGHJH2*01 (with a D), and light chain variable domains derived from recombination of human IGKV4-1*01 and IGKJ2*01; or 2. An antibody (eg, evolocumab) that comprises human heavy chain variable domains derived from recombination of human IGHV1-18*01 and IGHJ6*01 (with a D segment) and light chain variable domains derived from recombination of human IGLV2-14*01 and IGLJ2*01.

Thus, according to the invention, the skilled person is hereby provided with the required determination of specific binding of the ligand to PCSK9 variants. Applications of this determination are set out above in the context of methods and other aspects of the invention.

REFERENCES

Horton et al, Trends Biochem Sci. 2007 February; 32(2):71-7. Epub 2007 Jan. 9, Molecular biology of PCSK9: its role in LDL metabolism.

Seidah and Prat, J Mol Med (Berl). 2007 July; 85(7):685-96. Epub 2007 Mar. 10, The proprotein convertases are potential targets in the treatment of dyslipidemia.

Benjannet et al, J Biol Chem. 2004 Nov. 19; 279(47):48865-75. Epub 2004 Sep. 9, NARC-1/PCSK9 and its natural mutants: zymogen cleavage and effects on the low density lipoprotein (LDL) receptor and LDL cholesterol.

Lagace et al, J Clin Invest. 2006 November; 116(11):2995-3005, Secreted PCSK9 decreases the number of LDL receptors in hepatocytes and in livers of parabiotic mice.

Maxwell et al, Proc Natl Acad Sci USA. 2005 Feb. 8; 102(6): 2069-74. Epub 2005 Jan. 27, Overexpression of PCSK9 accelerates the degradation of the LDLR in a post-endoplasmic reticulum compartment.

Park et al, J Biol Chem. 2004 Nov. 26; 279(48):50630-8. Epub 2004 Sep. 22, Post-transcriptional regulation of low density lipoprotein receptor protein by proprotein convertase subtilisin/kexin type 9a in mouse liver.

Rashid et al, Proc Natl Acad Sci USA. 2005 Apr. 12; 102(15): 5374-9. Epub 2005 Apr. 1, Decreased plasma cholesterol and hypersensitivity to statins in mice lacking Pcsk9.

Kotowski et al, Am J Hum Genet. 2006 March; 78(3):410-22. Epub 2006 Jan. 20, A spectrum of PCSK9 alleles contributes to plasma levels of low-density lipoprotein cholesterol.

Chen et al, J Am Coll Cardiol. 2005 May 17; 45(10):1611-9. Epub 2005 Apr. 21, A common PCSK9 haplotype, encompassing the E670G coding single nucleotide polymorphism, is a novel genetic marker for plasma low-density lipoprotein cholesterol levels and severity of coronary atherosclerosis.

Pisciotta et al, Atherosclerosis. 2006 June; 186(2):433-40. Epub 2005 Sep. 23, Additive effect of mutations in LDLR and PCSK9 genes on the phenotype of familial hypercholesterolemia.

Zhao et al, Am J Hum Genet. 2006 September; 79(3):514-23. Epub 2006 Jul. 18, Molecular characterization of loss-of-function mutations in PCSK9 and identification of a compound heterozygote.

Seidah et al, Proc Natl Acad Sci USA. 2003 Feb. 4; 100(3): 928-33. Epub 2003 Jan. 27, The secretory proprotein convertase neural apoptosis-regulated convertase 1 (NARC-1): liver regeneration and neuronal differentiation.

Example 2

IL4 Receptor Alpha (IL4Ra; CD124)

Interleukin-4 (IL-4, also known as B cell stimulating factor or BSF-1) was originally characterized by its ability to stimulate the proliferation of B cells in response to low concentrations of antibodies directed to surface immunoglobulin. IL-4 has been shown to possess a broad spectrum of biological activities, including growth stimulation of T cells, mast cells, granulocytes, megakaryocytes and erythrocytes. IL-4 induces the expression of class II major histocompatibility complex molecules in resting B cells, and enhances the secretion of IgE and IgGI isotypes by stimulated B cells In an example, the invention provides a method of treating or reducing the risk of an IL4Ra-mediated disease or condition in a human in need thereof, the method comprising administering to said human a ligand (eg, an antibody or antibody fragment) that specifically binds a human IL4RA protein. The invention also provides a corresponding ligand.

The present invention provides anti-IL4Ra ligands; and IL4Ra-binding or targeting ligands as described herein. The ligands have a variety of utilities. Some of the ligands, for instance, are useful in specific binding assays, for genotyping or phenotyping humans, affinity purification of IL4Ra, in particular human IL4Ra or its ligands and in screening assays to identify other antagonists of IL4Ra activity. Some of the ligands of the invention are useful for inhibiting binding of IL4Ra to IL4, or inhibiting IL4Ra-mediated activities.

Anti-IL4Ra ligands (eg, antibodies and anti-sense RNA) have been developed based on targeting and neutralising so-called "wild-type" human IL4Ra, which is a commonly-occurring form (see, eg, SEQ ID NO: 67). While such therapies are useful for human patients harbouring this form of human IL4RA, the inventor considered it useful to investigate the possibility of targeting rarer—but still naturally-occurring—forms of IL4Ra amongst human populations. In this way, the inventor arrived at insight into the natural occurrences and distributions of rarer human IL4Ra forms that can serve as useful targets (at the protein or nucleic acid level) for human treatment, prophylaxis and diagnosis pertinent to diseases and conditions mediated or associated with IL4RA activity. This particularly provides for tailored therapies, prophylaxis and diagnosis in humans that are devoid of the common IL4Ra gene or protein.

The skilled person will know that SNPs or other changes that translate into amino acid variation can cause variability in activity and/or conformation of human targets to be addressed. This has spawned great interest in personalized medicine where genotyping and knowledge of protein and nucleotide variability is used to more effectively tailor medicines and diagnosis of patients. The invention, therefore, provides for tailored pharmaceuticals and testing that specifically addresses rarer IL4Ra polymorphic variant forms. Such forms or "alleles" (at the nucleotide level), comprise one or more changes at the nucleotide and amino acid levels from the corresponding common form nucleotide and amino acids sequences, ie, there are one or more non-synonymous changes at the nucleotide level that translate into one or more corresponding changes in the protein target in humans.

Furthermore, the inventor surprisingly realised that the rarer natural forms, although present in humans at much lower frequencies than the common form, nevertheless are represented in multiple and ethnically-diverse human populations and usually with many human examples per represented ethnic population. Thus, the inventor realised that targeting such rarer forms would provide for effective treatment, prophylaxis or diagnosis across many human ethnic populations, thereby extending the utility of the present invention.

With this realisation, the inventor realised that there is significant industrial and medical application for the invention in terms of guiding the choice of anti-IL4Ra ligand for administration to human patients for therapy and/or prophylaxis of IL4Ra-mediated or associated diseases or conditions. In this way, the patient receives drugs and ligands that are tailored to their needs—as determined by the patient's genetic or phenotypic makeup. Hand-in-hand with this, the invention provides for the genotyping and/or phenotyping of patients in connection with such treatment, thereby allowing a proper match of drug to patient. This increases the chances of medical efficacy, reduces the likelihood of inferior treatment using drugs or ligands that are not matched to the patient (eg, poor efficacy and/or side-effects) and avoids pharmaceutical mis-prescription and waste.

In developing this thinking, in this non-limiting example the present inventor decided to determine a set of human IL4Ra variants on the basis of the following criteria, these being criteria that the inventor realised would provide for useful medical drugs and diagnostics to tailored need in the human population. The inventor selected variants having at least 3 of the 4 following criteria:—

Naturally-occurring human IL4Ra variation having a cumulative human allele frequency of 35% or less;

Naturally-occurring human IL4Ra variation having a total human genotype frequency of about 50% or less;

Naturally-occurring human IL4Ra variation found in many different human ethnic populations (using the standard categorisation of the 1000 Genomes Project; see Table 2 below); and Naturally-occurring human IL4Ra variation found in many individuals distributed across such many different ethnic populations.

On the basis of these criteria, the inventor identified variants listed in Table 11 below. The inventor's selection included, as an additional or alternative consideration, selection for nucleotide variation that produced amino acid variation in corresponding IL4Ra forms (ie, non-synonymous variations), as opposed to silent variations that do not alter amino acid residues in the target protein.

In an example, the invention provides a method of treating or reducing the risk of an IL4Ra-mediated disease or condition in a human in need thereof, the method comprising administering to said human a ligand (eg, an antibody or antibody fragment) that specifically binds a human IL4RA protein that comprises a mutation selected from the group consisting of I75V, E400A, C431R, S503P, Q576R and S752A in SEQ ID NO: 67. As explained further below, these amino acid variations are found in naturally-occurring IL-4Ra variants in humans found in many populations. Said human comprises a nucleotide sequence encoding said IL4RA protein comprising said mutation selected from the group consisting of I75V, E400A, C431R, S503P, Q576R and S752A in SEQ ID NO: 67.

An example also provides a ligand (eg, an antibody or antibody fragment) for treating or reducing the risk of an IL4Ra-mediated disease or condition in a human in need thereof, the method comprising administering to said human said ligand, wherein the ligand specifically binds a human IL4RA protein that comprises a mutation selected from the group consisting of I75V, E400A, C431R, S503P, Q576R and S752A in SEQ ID NO: 67. Said human comprises a nucleotide sequence encoding said IL4RA protein comprising said mutation selected from the group consisting of I75V, E400A, C431R, S503P, Q576R and S752A in SEQ ID NO: 67.

In an example, the invention provides a method of targeting IL4Ra in a human, the method comprising administering to said human a ligand (eg, an antibody or antibody fragment) that specifically binds a human IL4RA protein that comprises a mutation selected from the group consisting of I75V, E400A, C431R, S503P, Q576R and S752A in SEQ ID NO: 67. Said human comprises a nucleotide sequence encoding said IL4RA protein comprising said mutation selected from the group consisting of I75V, E400A, C431R, S503P, Q576R and S752A in SEQ ID NO: 67. In an example, the human is suffering from or at risk of an IL4Ra-mediated disease or condition. In an example, the method treats or reduces the risk of an IL4Ra-mediated disease or condition in the human.

An example also provides a ligand (eg, an antibody or antibody fragment) for targeting IL4Ra in a human, the method comprising administering to said human said ligand, wherein the ligand specifically binds a human IL4RA protein that comprises a mutation selected from the group consisting of I75V, E400A, C431R, S503P, Q576R and S752A in SEQ ID NO: 67. Said human comprises a nucleotide sequence encoding said IL4RA protein comprising said mutation selected from the group consisting of I75V, E400A, C431R, S503P, Q576R and S752A in SEQ ID NO: 67. In an example, the human is suffering from or at risk of an IL4Ra-mediated disease or condition. In an example, the method treats or reduces the risk of an IL4Ra-mediated disease or condition in the human.

In an embodiment, (i) the antibody or fragment comprises a VH domain derived from the recombination of a human VH segment, a human D gene segment and a human JH segment, the human VH segment encoding the framework 1 of SEQ ID NO: 40 and wherein said human comprises a VH gene segment encoding the framework 1 of SEQ ID NO: 40, or the human expresses VH domains that comprise the framework 1 of SEQ ID NO: 40; and wherein (ii) said human comprises a nucleotide sequence encoding said IL4RA protein comprising said mutation selected from the group consisting of I75V, E400A, C431R, S503P, Q576R and S752A in SEQ ID NO: 67.

Additionally or alternatively, in an embodiment, (i) the antibody or fragment comprises a human gamma-4 heavy chain constant region that comprises a Leu at position 189 shown in SEQ ID NO: 73 or an Arg at position 289 shown in SEQ ID NO: 73 and wherein said human comprises an IGHG4*01 human heavy chain constant region gene segment, or the human expresses antibodies comprising human gamma-4 heavy chain constant regions comprising a Leu at position 189 shown in SEQ ID NO: 73 or an Arg at position 289 shown in SEQ ID NO: 73; and wherein (ii) said human comprises a nucleotide sequence encoding said IL4RA protein comprising said mutation selected from the group consisting of I75V, E400A, C431R, S503P, Q576R and S752A in SEQ ID NO: 67.

The biological activities of IL-4 are mediated by specific cell surface receptors for IL-4. Human IL-4 receptor alpha (hIL-4Ra) is described in, for example, U.S. Pat. Nos. 5,599,905, 5,767,065, and 5,840,869. Antibodies to hIL-4R are described in U.S. Pat. No. 5,717,072.

Methods for using antibodies to hIL-4R are described in U.S. Pat. Nos. 5,714,146; 5,985,280; and 6,716,587.

The human IL-4Ra (aka IL-4Rα) subunit (Swiss Prot accession number P24394) is a 140 kDa type 1 membrane protein that binds human IL-4 with a high affinity (Andrews et al J. Biol. Chem (2002) 277:46073-46078). The IL-4/IL-4Ra complex can dimerize with either the common gamma chain (γc, CD132) or the IL-13Ralpha1 (IL-13Rα1) subunit, via domains on IL-4, to create two different signalling complexes, commonly referred to as Type I and Type II receptors, respectively. Alternatively, IL-13 can bind IL-13Rα1 to form an IL-13/IL-13Rα1 complex that recruits the IL-4Rα subunit to form a Type II receptor complex. Thus, IL-4Rα mediates the biological activities of both IL-4 and IL-13 (reviewed by Gessner et al, Immunobiology, 201:285, 2000). In vitro studies have shown that IL-4 and IL-13 activate effector functions in a number of cell types, for example in T cells, B cells, eosinophils, mast cells, basophils, airway smooth muscle cells, respiratory epithelial cells, lung fibroblasts, and endothelial cells (reviewed by Steinke et al, Resp Res, 2:66, 2001, and by Willis-Karp, Immunol Rev, 202:175, 2004).

IL-4 by binding to its receptor (IL-4R) is essential for the development of airway inflammation present in asthma, through the induction of IgE synthesis in B cells and differentiation of T cells to a Th2 phenotype. Dupilumab is a monoclonal antibody designed for the treatment of atopic diseases. It binds to the alpha subunit of the interleukin-4 receptor. Through blockade of IL-4R alpha, dupilumab modulates signaling of both the IL-4 and IL-13 pathway, which have been implicated in the pathophysiology of allergic disease. Anti-IL4Ra ligands, antibodies and fragments according to the invention can, for example, be used for treating or reducing the risk of allergic disease.

In an example, the ligand, antibody or fragment is for treating or reducing the risk of (or treats or reduces the risk of) allergic asthma, eosinophilic asthma or atopic dermatitis, optionally wherein the antibody is dupilumab.

In addition to its role in asthma, IL-4Ra has been linked with a number of other pathologies, e.g. as follows (anti-IL4Ra ligands, antibodies and fragments according to the invention can, for example, be used for treating or reducing the risk of any one of these diseases or conditions):

Chronic Obstructive Pulmonary Disease (COPD) includes patient populations with varying degrees of chronic bronchitis, small airway disease and emphysema and is characterised by progressive irreversible lung function decline that responds poorly to current asthma based therapy. The underlying causes of COPD remain poorly understood. The "Dutch hypothesis" proposes that there is a common susceptibility to COPD and asthma and therefore, that similar mechanisms may contribute to the pathogenesis of both disorders (Sluiter et al., Eur Respir J,). Zheng et al (J Clin Invest, 106(9):1081-93, 2000) have demonstrated that overexpression ofIL-13 in the mouse lung caused emphysema, elevated mucus production and inflammation, reflecting aspects of human COPD. Furthermore, AHR, an IL-13 dependent response in murine models of allergic inflammation, has been shown to be predictive of lung function decline in smokers (Tashkin et al., Am J Respir Crit Care Med, 153(6 Pt 1):1802-11, 1996). A link has also been established between an IL-13 promoter polymorphism and susceptibility to develop COPD (Van Der Pouw Kraan et al., Genes Immun, 3(7): 436-9, 2002). The signs are therefore that IL-4/IL-13 pathway, and in particular IL-13, plays an important role in the pathogenesis of COPD.

In addition to asthma, the IL-4/Il-13 pathway has been linked to other fibrotic conditions, like systemic sclerosis (Hasegawa et al., J Rheumatol, 24(2):328-32, 1997), pulmonary fibrosis (Hancock et al., Am J Respir Cell Mol Biol, 18(1): 60-5, 1998), parasite-induced liver fibrosis (Fallon et al., J Immunol, 164(5): 2585-91, 2000; Chiaramonte et al., J Clin Invest, 104(6): 777-85, 1999; Chiaramonte Hepatology 34(2):273-82, 2001), and cystic fibrosis (Hauber et al., J. Cyst Fibr, 2:189, 2003).

IL-4 and to some extent IL-13, are crucial for B cell mediated activities, such as B cell proliferation, immunoglobulin secretion, and expression of FcepsilonR. Clinical applications of an IL-4Ra inhibitor include for example, use in allergy therapy to suppress IgE synthesis (including for example atopic dermatitis and food allergy), use in transplation therapy to prevent transplant rejection, as well as suppression of delayed-type hypersensitivity or contact hypersensitivity reactions.

Il-4R antagonists may also find use as adjuvants to allergy immunotherapy and as vaccine adjuvants.

IL-4Ra polymorphisms in the human population have been described (reviewed by Gessner et al, Immunobiology, 201: 285, 2000) and association with IgE levels or clinical atopy has been reported in some populations. For instance, V75R576 IL-4Rα is associated with allergic asthma and enhanced IL-4Rα function (Risma et al. J. Immunol. 169(3): 1604-1610, 2002).

Anti-IL4Ra ligands, antibodies and fragments according to the invention optionally neutralise IL-4Ra with high potency, for example as described in more detail in the Examples of EP2604628. Neutralisation means inhibition of a biological activity mediated by IL-4Ra. Ligands, antibodies and fragments according to the invention may neutralise one or more activities mediated by IL-4Ra. The inhibited biological activity is likely mediated by prevention of IL-4Ra forming a signalling complex with gamma chain (or IL-13Ra) and either of the associated soluble ligands, e.g. IL-4 or IL-13.

Neutralisation of IL-4 or IL-13 signalling through its IL-4Ra containing receptor complex may be measured by inhibition of IL-4 or IL-13 stimulated TF-1 cell proliferation.

The ligand, antibody or fragment according to the invention is, for example, dupilumab or any one disclosed in WO 08/054606 (Regeneron), EP2604628 (Medimmune), WO 01/92340 (immnunex) or WO 05/047331 (Immunex), the disclosures of which (including the sequences, eg, VH, VL and heavy and light chain sequences) are incorporated herein by reference for potential inclusion in one or more claims herein. According to a further aspect of the ligand, antibody or fragment according to the invention is capable of binding human interleukin-4 receptor alpha (hIL-4Ra) and cynomolgus monkey interleukin-4 receptor alpha (cyIL-4Ra). Cynomolgus IL-4Ra cDNA sequence is shown as SEQ ID NO: 455 EP2604628. In a particular embodiment the antibody or fragment is a human antibody or fragment. The ligand, antibody or fragment according to the invention is an antibody or fragment, for example, that comprises a VH and/or VL of dupilumab, or comprises a heavy and/or light chain of dupilumab. In one embodiment, the ligand, antibody or fragment comprises a VH domain comprising SEQ ID NO: 69. In one embodiment, the ligand, antibody or fragment comprises a VL domain comprising SEQ ID NO: 70. In one embodiment, the ligand, antibody or fragment comprises a heavy chain comprising SEQ ID NO: 71. In one embodiment, the ligand, antibody or fragment comprises a light chain comprising SEQ ID NO: 72.

In a specific embodiment, the ligand, antibody or fragment of present invention comprises an Fc region, wherein the Fc region comprises at least one non-native amino acid residue selected from the group consisting of 234D, 234E, 234N, 234Q, 234T, 234H, 234Y, 234I, 234V, 234F, 235A, 235D, 235R, 235W, 235P, 235S, 235N, 235Q, 235T, 235H, 235Y, 235I, 235V, 235F, 236E, 239D, 239E, 239N, 239Q, 239F, 239T, 239H, 239Y, 240I, 240A, 240T, 240M, 241W, 241 L, 241Y, 241E, 241 R. 243W, 243L 243Y, 243R, 243Q, 244H, 245A, 247L, 247V, 247G, 251F, 252Y, 254T, 255L, 256E, 256M, 262I, 262A, 262T, 262E, 263I, 263A, 263T, 263M, 264L, 264I, 264W, 264T, 264R, 264F, 264M, 264Y, 264E, 265G, 265N, 265Q, 265Y, 265F, 265V, 265I, 265L, 265H, 265T, 266I, 266A, 266T, 266M, 267Q, 267L, 268E, 269H, 269Y, 269F, 269R, 270E, 280A, 284M, 292P, 292L, 296E, 296Q, 296D, 296N, 296S, 296T, 296L, 296I, 296H, 269G, 297S, 297D, 297E, 298H, 298I, 298T, 298F, 299I, 299L, 299A, 299S, 299V, 299H, 299F, 299E, 305I, 313F, 316D, 325Q, 325L, 325I, 325D, 325E, 325A, 325T, 325V, 325H, 327G, 327W, 327N, 327L, 328S, 328M, 328D, 328E, 328N, 328Q, 328F, 328I, 328V, 328T, 328H, 328A, 329F, 329H, 329Q, 330K, 330G, 330T, 330C, 330L, 330Y, 330V, 330I, 330F, 330R, 330H, 331G, 331A, 331L, 331M, 331F, 331W, 331K, 331Q, 331E, 331S, 331V, 331I, 331C, 331Y, 331H, 331R, 331N, 331D, 331T, 332D, 332S, 332W, 332F, 332E, 332N, 332Q, 332T, 332H, 332Y, 332A, 339T, 370E, 370N, 378D, 392T, 396L, 416G, 419H, 421K, 440Y and 434W as numbered by the EU index as set forth in Kabat. Optionally, the Fc region may comprise additional and/or alternative non-native amino acid residues known to one skilled in the art (see, e.g., U.S. Pat. Nos. 5,624,821; 6,277,375; 6,737,056; PCT Patent Publications WO 01/58957; WO 02/06919; WO 04/016750; WO 04/029207; WO 04/035752 and WO 05/040217).

The ligand, antibody or fragment according to the invention is for treating or preventing or reducing the risk of (or treats or prevents or reduces the risk of), for example, any disease or condition disclosed in any of WO 08/054606 (Regeneron), EP2604628 (Medimmune), WO 01/92340 (immnunex) and WO 05/047331 (Immunex), the disclosures of which diseases and conditions are incorporated herein by reference for potential inclusion in one or more claims herein.

Further encompassed by the invention is the use of the ligand, antibody or fragment in the manufacture of a medicament for use to attenuate or inhibit an IL-4Ra-mediated disease or disorder in a human. IL-4Ra-mediated or related disorders which are treated by the ligand, antibody or fragment of the invention include, for example, arthritis (including septic arthritis), herpetiformis, chronic idiopathic urticaria, scleroderma, hypertrophic scarring, Whipple's Disease, benign prostate hyperplasia, lung disorders, such as mild, moderate or severe asthma, inflammatory disorders such as inflammatory bowel disease, allergic reactions, Kawasaki disease, sickle cell disease, Churg-Strauss syndrome, Grave's disease, pre-eclampsia, Sjogren's syndrome, autoimmune lymphoproliferative syndrome, autoimmune hemolytic anemia, Barrett's esophagus, autoimmune uveitis, tuberculosis, and nephrosis.

Particular conditions for which a ligand, antibody or fragment of the invention may be used in treatment or diagnosis include: asthma, COPD (eg, chronic bronchitis, small airway disease or emphysema), inflammatory bowel disease, a fibrotic condition (eg, systemic sclerosis, pulmonary fibrosis, parasite-induced liver fibrosis, or cystic fibrosis), allergy (for example atopic dermatitis, dust mite allergy, pet allergy or food allergy), transplation therapy to prevent transplant rejection, suppression of a delayed-type hypersensitivity or a contact hypersensitivity reaction, as an adjuvant to allergy immunotherapy or as a vaccine adjuvant. In an example, the method and ligand are for treating or preventing (or reducing the risk of) nasaly polyps and/or sinusitis.

Thus, a ligand, antibody or fragment of the invention is useful as a therapeutic agent in the treatment of a condition involving IL-4, IL-13 or IL-4Ra expression and/or activity. One embodiment, among others, is a method of treatment comprising administering an effective amount of a ligand, antibody or fragment of the invention to a patient in need thereof, wherein functional consequences of IL-4Ra activation are decreased. Another embodiment, among others, is a method of treatment comprising (i) identifying a patient demonstrating IL-4, IL-13 or IL-4Ra expression or activity, and (ii) administering an effective amount of a ligand, antibody or fragment of the invention to the patient, wherein a functional consequence of IL-4Ra activation are attenuated. An effective amount according to the invention is an amount that modulates (e.g. decreases) the functional consequences of IL-4Ra activation so as to modulate (e.g. decrease or lessen) the severity of at least one symptom of the particular disease or disorder being treated, but not necessarily cure the disease or disorder. Accordingly, one embodiment of the invention is a method of treating or reducing the severity of at least one symptom of any of the disorders referred to herein, comprising administering to a patient in need thereof an effective amount of one or more ligands, antibodies or fragments of the present invention alone or in a combined therapeutic regimen with another appropriate medicament known in the art or described herein such that the severity of at least one symptom of any of the disorders is reduced. Another embodiment of the invention, among others, is a method of antagonizing at least one effect of IL-4Ra comprising contacting with or administering an effective amount of one or more ligands, antibodies or fragments of the present invention such that said at least one effect of IL-4Ra is antagonized, e.g. the ability of IL-4Ra to form a complex (the precursor to active signalling) with IL-4.

A ligand, antibody or fragment of the invention can, in an example, be used in combination with another therapeutic agent for the treatment of cancer. Suitable agents to be used in combination include those disclosed in EP2604628 (eg, in paragaraph [0287]), which disclosure is incorporated herein by reference.

Tailoring Antibodies to Rarer IL4Ra Variant Profile

As outlined herein (for example, in the context of PCSK9 in Example 1), the invention includes the possibility to tailor treatment of humans further by selecting antibody-based ligands with variable domains and/or constant domains based on gene segments found in many humans of the ethnic populations where the variant TOI forms are found to meet the selection criteria of the invention. This also applies mutatis mutandis where the TOI is human IL4Ra, as in the present example. Thus, all disclosure herein relating to tailoring variable and/or constant domains apply to the present example, relating to IL4Ra and is combinable for use in one or more claims herein.

As described in Example 1, an example is provided for ligands comprising antibody VH domains derived from recombination of human IGHV gene segments comprising selected nucleotides at positions in the HCDR1 or FW3 where there is variability in humans (ie, where SNPs occur in humans).

Further information is provided in Table 4, which shows variation at these positions, as well as the variant distributions across the 1000 Genomes Project database relating to many human populations.

In other embodiments, as explained more fully above, the invention provides for ligands which are tailored to the human recipient's genotype and/or phenotype based on alternative human VH gene segments, or on Vκ, Vλ or constant region gene segments (see further Table 9 for representative variants).

In an example, following this guidance, the chosen ligand is dupilumab.

Further examples, therefore are:—
(i) wherein the ligand comprises a VH domain derived from the recombination of a human VH segment (eg, human VH3-23*04), a human D gene segment and a human JH segment, the human VH segment encoding the framework 1 of SEQ ID NO: 40 and wherein said human comprises a VH gene segment encoding the framework 1 of SEQ ID NO: 40, or the human expresses VH domains that comprise the framework 1 of SEQ ID NO: 40.

(ii) wherein the ligand comprises a VH domain derived from the recombination of human VH segment IGHV3-7*01, a human D gene segment and a human JH segment, and wherein said human comprises a IGHV3-7*01 VH gene segment or the human expresses VH domains derived from the recombination of human VH segment IGHV3-7*01, a human D gene segment and a human JH segment.

(iii) wherein the ligand comprises a Vκ domain derived from the recombination of human Vκ segment IGKV1-12*01 and a human Jκ segment, and wherein said human comprises a IGKV1-12*01 Vκ gene segment or the human expresses Vκ domains derived from the recombination of human Vκ segment IGKV1-12*01 and a human Jκ segment.

(iv) wherein the ligand comprises a Vκ domain derived from the recombination of a human Vκ segment and a human Jκ segment, the human Vκ segment encoding (i) a CDR3 comprising a Pro at position 7 shown in SEQ ID NO: 36 and wherein said human comprises a Vκ gene segment encoding a CDR3 comprising a Pro at position 7 shown in SEQ ID NO: 36, or the human expresses Vκ domains that comprise a CDR3 comprising a Pro at position 7 shown in SEQ ID NO: 36; or (ii) a FW3 comprising a Ser at position 15 shown in SEQ ID NO: 38 and wherein said human comprises a Vκ gene segment encoding a FW3 comprising a Ser at position 15 shown in SEQ ID NO: 38 or the human expresses Vκ domains that comprise a FW3 comprising a Ser at position 15 shown in SEQ ID NO: 38.

(v) wherein the ligand comprises a human gamma-1 heavy chain constant region that comprises an Asp at position 204 shown in SEQ ID NO: 4 or a Leu at position 206 shown in SEQ ID NO: 4 and wherein said human comprises (i) an IGHG1*01 human heavy chain constant region gene segment, or the human expresses antibodies comprising human gamma-1 heavy chain constant regions comprising an Asp at position 204 shown in SEQ ID NO: 4 or a Leu at position 206 shown in SEQ ID NO: 4.

(vi) wherein the ligand comprises a human gamma-2 heavy chain constant region that comprises an amino acid selected from the group consisting of a Pro at position 72 shown in SEQ ID NO: 6, an Asn at position 75 shown in SEQ ID NO: 6, a Phe at position 76 shown in SEQ ID NO: 6, a Val at position 161 shown in SEQ ID NO: 6 and an Ala at position 257 shown in SEQ ID NO: 6 and wherein said human comprises (i) an IGHG2*01 human heavy chain constant region gene segment, or the human expresses antibodies comprising human gamma-2 heavy chain constant regions comprising said selected Pro at position 72 shown in SEQ ID NO: 6, Asn at position 75 shown in SEQ ID NO: 6, Phe at position 76 shown in SEQ ID NO: 6, Val at position 161 shown in SEQ ID NO: 6 or Ala at position 257 shown in SEQ ID NO: 6.

(vii) wherein the ligand comprises a human kappa chain constant region that comprises a Val at position 84 shown in SEQ ID NO: 16 or a Cys at position 87 shown in SEQ ID NO: 16 and wherein said human comprises (i) an IGKC1*01 human kappa chain constant region gene segment, or the human expresses antibodies comprising human kappa chain constant regions comprising a Val corresponding to position 84 shown in SEQ ID NO: 16 or a Cys at position 87 shown in SEQ ID NO: 16.

(viii) wherein the ligand comprises a human IGLC1*01 lambda chain constant region and wherein said human comprises (i) a human IGLC1*01 lambda chain constant region gene segment, or the human expresses antibodies comprising human IGLC1*01 lambda chain constant regions.

(ix) wherein the ligand comprises a human gamma-4 heavy chain constant region that comprises a Leu at position 189 shown in SEQ ID NO: 73 or an Arg at position 289 shown in SEQ ID NO: 73 and wherein said human comprises (i) an IGHG4*01 human heavy chain constant region gene segment, or the human expresses antibodies comprising human gamma-4 heavy chain constant regions comprising a Leu at position 189 shown in SEQ ID NO: 73 or an Arg at position 289 shown in SEQ ID NO: 73.

For example, as per example (ix), the inventor identified the possibility of addressing IGH-gamma-4 variation and identified utility for variations 189L and 289R individually or in combination, since these residues are part of the CH3 domain, and as such they form part of antibody Fc regions. Thus, matching of these CH3 variations with the patient is especially beneficial for reasons as discussed above. Thus, in this example the ligand of the invention comprises or consists of an antibody that comprises a human gamma-4 heavy chain constant region that comprises a Leu corresponding to position 189 of SEQ ID NO: 73 or an Arg corresponding to position 289 of SEQ ID NO: 73 and wherein the genome of the human comprises a gamma-4 heavy chain constant region nucleotide sequence that encodes such a Leu and/or Arg or the human expresses antibodies comprising human gamma-4 constant regions comprising such a Leu and/or Arg. An example of such a ligand is dupilumab.

Determination of Specific Binding of Ligands of the Invention to IL4RA Variants

The specific binding of Ligands of the invention to IL4Ra variants can be performed using the SPR method described in Example 1.

Embodiments are provided as follows:—

Methods with VH Tailoring

1. A method of treating or reducing the risk of an IL4Ra-mediated disease or condition in a human in need thereof, the method comprising administering to said human a ligand (eg, an antibody or antibody fragment) that specifically binds a human IL4Ra protein that comprises a mutation selected from the group consisting of I75V, E400A, C431R, S503P, Q576R and S752A in SEQ ID NO: 67;
    wherein (i) the ligand comprises a VH domain derived from the recombination of a human VH segment, a human D gene segment and a human JH segment, the human VH segment encoding the framework 1 of SEQ ID NO: 40 and wherein said human comprises a VH gene segment encoding the framework 1 of SEQ ID NO: 40, or the human expresses VH domains that comprise the framework 1 of SEQ ID NO: 40; and
    wherein (ii) said human comprises a nucleotide sequence encoding said IL4RA protein comprising said mutation selected from the group consisting of I75V, E400A, C431R, S503P, Q576R and S752A in SEQ ID NO: 67.

In an alternative, clause 1 provides:—

A method of targeting IL4Ra in a human, the method comprising administering to said human a ligand (eg, an antibody or antibody fragment) that specifically binds a human IL4Ra protein that comprises a mutation selected from the group consisting of I75V, E400A, C431R, S503P, Q576R and S752A in SEQ ID NO: 67;
wherein (i) the ligand comprises a VH domain derived from the recombination of a human VH segment, a human D gene segment and a human JH segment, the human VH segment encoding the framework 1 of SEQ ID NO: 40 and wherein said human comprises a VH gene segment encoding the framework 1 of SEQ ID NO: 40, or the human expresses VH domains that comprise the framework 1 of SEQ ID NO: 40; and
wherein (ii) said human comprises a nucleotide sequence encoding said IL4RA protein comprising said mutation selected from the group consisting of I75V, E400A, C431R, S503P, Q576R and S752A in SEQ ID NO: 67.

In an example, the human is suffering from or at risk of an IL4Ra-mediated disease or condition.

In an example, the method treats or reduces the risk of an IL4Ra-mediated disease or condition in the human. Optionally the disease is asthma. Optionally the disease is atopic dermatitis. Optionally the disease is nasal polyps and/or sinusitis.

In an example of the method or ligand of the invention, the IL4Ra comprises mutation I75V.

In an example of the method or ligand of the invention, the IL4Ra comprises mutation E400A.

In an example of the method or ligand of the invention, the IL4Ra comprises mutation C431R.

In an example of the method or ligand of the invention, the IL4Ra comprises mutation S503P.

In an example of the method or ligand of the invention, the IL4Ra comprises mutation Q576R.

In an example of the method or ligand of the invention, the IL4Ra comprises mutation S752A.

2. The method of clause 1, wherein the IL4Ra comprises mutations I75V and Q576R in SEQ ID NO: 67 and optionally the disease is asthma. Optionally the disease is atopic dermatitis. Optionally the disease is nasal polyps and/or sinusitis.

Q576R and I75V are associated with airway inflammation disease, eg, asthma. For example, see Clin Exp Allergy. 2003 August; 33(8):1111-7, "Polymorphisms in the interleukin-4 and interleukin-4 receptor alpha chain genes confer susceptibility to asthma and atopy in a Caucasian population", Beghé B et al (referring to I75V instead as I50V); J Asthma. 2010 April; 47(3):238-44. doi: 10.3109/02770900903509099, "Association and gene-gene interactions of eight common single-nucleotide polymorphisms with pediatric asthma in middle china", Wu X et al; Clin Exp Allergy. 2004 October; 34(10):1570-5, "Haplotypes of the interleukin-4 receptor alpha chain gene associate with susceptibility to and severity of atopic asthma", Hytönen A M et al, all incorporated herein by reference.

3. The method of clause 1 or 2, wherein the nucleotide sequence of (ii) comprises nucleotide mutation −3223T (dB SNP numbering).

This variation is associated with airway inflammation disease, eg, asthma.

4. The method of any preceding clause, wherein each said human VH gene segment comprises SEQ ID NO: 39.

5. The method of any preceding clause, wherein the VH gene segment comprised by said human is a germline VH gene segment.

6. The method of any preceding clause comprising, before said administering, selecting a human comprising said nucleotide sequence of (ii), wherein the human is the human of clause 1.

7. The method of any preceding clause, wherein the human has been determined to comprise the nucleotide sequence that encodes an IL4Ra protein comprising said mutation selected from the group consisting of I75V, E400A, C431R, S503P, Q576R and S752A in SEQ ID NO: 67 and/or an IL4Ra protein comprising said mutation selected from the group consisting of I75V, E400A, C431R, S503P, Q576R and S752A in SEQ ID NO: 67.

8. The method of any preceding clause, comprising the step of determining that the human comprises (a) the nucleotide sequence that encodes an IL4Ra protein comprising said mutation selected from the group consisting of I75V, E400A, C431R, S503P, Q576R and S752A in SEQ ID NO:

67 and/or (b) an IL4Ra protein comprising said mutation said mutation selected from the group consisting of I75V, E400A, C431R, S503P, Q576R and S752A in SEQ ID NO: 67, optionally, wherein the determining step is performed before administration of the antibody to the human.

9. The method of clause 8, wherein the step of determining comprises assaying a biological sample from the human for a nucleotide sequence encoding a IL4Ra protein comprising said mutation selected from the group consisting of I75V, E400A, C431R, S503P, Q576R and S752A in SEQ ID NO: 67.

10. The method of clause 9, wherein the assaying comprises contacting the biological sample with at least one oligonucleotide probe comprising a sequence of at least 10 contiguous nucleotides of a nucleotide sequence encoding an IL4Ra protein comprising said mutation selected from the group consisting of I75V, E400A, C431R, S503P, Q576R and S752A in SEQ ID NO: 67 or comprising an antisense sequence of said contiguous nucleotides, wherein said sequence of contiguous nucleotides comprises a nucleotide sequence encoding said mutation selected from the group consisting of I75V, E400A, C431R, S503P, Q576R and S752A in SEQ ID NO: 67, thereby forming a complex when at least one nucleotide sequence encoding the IL4Ra protein comprising said mutation selected from the group consisting of I75V, E400A, C431R, S503P, Q576R and S752A in SEQ ID NO: 67 is present; and
detecting the presence or absence of the complex, wherein detecting the presence of the complex determines that the human comprises the IL4Ra protein comprising said mutation selected from the group consisting of I75V, E400A, C431R, S503P, Q576R and S752A in SEQ ID NO: 67.

11. The method of clause 9, wherein the assaying comprises nucleic acid amplification and optionally one or more methods selected from sequencing, next generation sequencing, nucleic acid hybridization, and allele-specific amplification and/or wherein the assaying is performed in a multiplex format.

12. The method of clause 9 or 11, wherein said biological sample comprises serum, blood, feces, tissue, a cell, urine and/or saliva of said human.

13. The method of any preceding clause, wherein said human is indicated as heterozygous for a nucleotide sequence encoding the IL4Ra protein comprising said mutation selected from the group consisting of I75V, E400A, C431R, S503P, Q576R and S752A in SEQ ID NO: 67, optionally, wherein said human is further indicated as comprising the nucleotide sequence of SEQ ID NO: 68, or said human is indicated as homozygous for a nucleotide sequence encoding the IL4Ra protein comprising said mutation selected from the group consisting of I75V, E400A, C431R, S503P, Q576R and S752A in SEQ ID NO: 67.

14. The method of any preceding clause, wherein said human is or has been further determined to be substantially resistant to an asthma treatment.

15. The method of any preceding clause, wherein said human is receiving or has received an asthma treatment or has reduced responsiveness to an asthma treatment.

16. The method of any preceding clause, wherein said disease or condition is an inflammatory disease or condition; an atopic disease or condition; a respiratory disease or condition; a disease or condition associated with elevated IgE; or a disease or condition associated with elevated IL-4 and/or IL-13 activity.

17. The method of any preceding clause, wherein said disease or condition is selected from the group consisting of an airway inflammatory disease or condition, chronic obstructive pulmonary disease, asthma, pneumonia, hypersensitivity pneumonitis, pulmonary infiltrate with eosinophilia, environmental lung disease, pneumonia, bronchiectasis, cystic fibrosis, interstitial lung disease, primary pulmonary hypertension, pulmonary thromboembolism, disorders of the pleura, disorders of the mediastinum, disorders of the diaphragm, hypoventilation, hyperventilation, sleep apnea, acute respiratory distress syndrome, mesothelioma, sarcoma, graft rejection, graft versus host disease, lung cancer, allergic rhinitis, allergy, asbestosis, aspergilloma, aspergillosis, bronchiectasis, chronic bronchitis, emphysema, eosinophilic pneumonia, idiopathic pulmonary fibrosis, invasive pneumococcal disease, influenza, nontuberculous mycobacteria, pleural effusion, pneumoconiosis, pneumocytosis, pneumonia, pulmonary actinomycosis, pulmonary alveolar proteinosis, pulmonary anthrax, pulmonary edema, pulmonary embolus, pulmonary inflammation, pulmonary histiocytosis X, pulmonary hypertension, pulmonary nocardiosis, pulmonary tuberculosis, pulmonary veno-occlusive disease, rheumatoid lung disease, sarcoidosis, and Wegener's granulomatosis.

18. The method of any preceding clause, wherein said human has been diagnosed with at least one condition selected from the group consisting of an airway inflammatory disease or condition, chronic obstructive pulmonary disease, asthma, pneumonia, hypersensitivity pneumonitis, pulmonary infiltrate with eosinophilia, environmental lung disease, pneumonia, bronchiectasis, cystic fibrosis, interstitial lung disease, primary pulmonary hypertension, pulmonary thromboembolism, disorders of the pleura, disorders of the mediastinum, disorders of the diaphragm, hypoventilation, hyperventilation, sleep apnea, acute respiratory distress syndrome, mesothelioma, sarcoma, graft rejection, graft versus host disease, lung cancer, allergic rhinitis, allergy, asbestosis, aspergilloma, aspergillosis, bronchiectasis, chronic bronchitis, emphysema, eosinophilic pneumonia, idiopathic pulmonary fibrosis, invasive pneumococcal disease, influenza, nontuberculous mycobacteria, pleural effusion, pneumoconiosis, pneumocytosis, pneumonia, pulmonary actinomycosis, pulmonary alveolar proteinosis, pulmonary anthrax, pulmonary edema, pulmonary embolus, pulmonary inflammation, pulmonary histiocytosis X, pulmonary hypertension, pulmonary nocardiosis, pulmonary tuberculosis, pulmonary veno-occlusive disease, rheumatoid lung disease, sarcoidosis, and Wegener's granulomatosis.

19. The method of any preceding clause, wherein said antibody or antibody fragment treats or reduces the risk in said human of at least one condition selected from the group consisting of an airway inflammatory disease or condition, chronic obstructive pulmonary disease, asthma, pneumonia, hypersensitivity pneumonitis, pulmonary infiltrate with eosinophilia, environmental lung disease, pneumonia, bronchiectasis, cystic fibrosis, interstitial lung disease, primary pulmonary hypertension, pulmonary thromboembolism, disorders of the pleura, disorders of the mediastinum, disorders of the diaphragm, hypoventilation, hyperventilation, sleep apnea, acute respiratory distress syndrome, mesothelioma, sarcoma, graft rejection, graft versus host disease, lung cancer, allergic rhinitis, allergy, asbestosis, aspergilloma, aspergillosis, bronchiectasis, chronic bronchitis, emphysema, eosinophilic pneumonia, idiopathic pulmonary fibrosis, invasive pneumococcal disease, influenza, nontuberculous mycobacteria, pleural effusion, pneumoconiosis, pneumocytosis, pneumonia, pulmonary actinomycosis, pulmonary alveolar proteinosis, pulmonary anthrax, pulmonary edema, pulmonary embolus, pulmonary inflammation, pulmonary histiocytosis X, pulmonary hypertension, pulmonary nocardiosis, pulmonary tuberculosis, pulmonary veno-occlusive disease, rheumatoid lung disease, sarcoidosis, and Wegener's granulomatosis 20. The method of any preceding clause, wherein the nucleotide sequence comprises one or more SNPs selected from the group consisting of rs1805010, rs1805011, rs1805012, rs1805015, rs1801275 and rs1805016.
21. The method of any preceding clause, wherein said antibody or antibody fragment is administered by inhaled, intravenous or subcutaneous administration and/or is comprised in an inhalable or injectable preparation.
22. The method of any preceding clause, wherein the VH domain comprises the amino acid sequence of SEQ ID NO: 69.

Ligands with VH Tailoring

1. A ligand (eg, an antibody or antibody fragment) for use in a method of treating or reducing the risk of an IL4Ra-mediated disease or condition (eg, asthma) in a human in need thereof, wherein the ligand specifically binds a human IL4RA protein that comprises a mutation selected from the group consisting of I75V, E400A, C431R, S503P, Q576R and S752A in SEQ ID NO: 67;
   wherein (i) the ligand comprises a VH domain derived from the recombination of a human VH segment, a human D gene segment and a human JH segment, the human VH segment encoding the framework 1 of SEQ ID NO: 40 and wherein said human comprises a VH gene segment encoding the framework 1 of SEQ ID NO: 40, or the human expresses VH domains that comprise the framework 1 of SEQ ID NO: 40; and
   wherein (ii) said human comprises a nucleotide sequence encoding said IL4RA protein comprising said mutation selected from the group consisting of I75V, E400A, C431R, S503P, Q576R and S752A in SEQ ID NO: 67.

In an alternative, paragraph 1 provides:—

A ligand (eg, an antibody or antibody fragment) for use in a method of targeting IL4Ra in a human, wherein the ligand specifically binds a human IL4RA protein that comprises a mutation selected from the group consisting of I75V, E400A, C431R, S503P, Q576R and S752A in SEQ ID NO: 67;
wherein (i) the ligand comprises a VH domain derived from the recombination of a human VH segment, a human D gene segment and a human JH segment, the human VH segment encoding the framework 1 of SEQ ID NO: 40 and wherein said human comprises a VH gene segment encoding the framework 1 of SEQ ID NO: 40, or the human expresses VH domains that comprise the framework 1 of SEQ ID NO: 40; and
wherein (ii) said human comprises a nucleotide sequence encoding said IL4RA protein comprising said mutation selected from the group consisting of I75V, E400A, C431R, S503P, Q576R and S752A in SEQ ID NO: 67.

In an example, the human is suffering from or at risk of an IL4Ra-mediated disease or condition.

In an example, the method treats or reduces the risk of an IL4Ra-mediated disease or condition in the human.

2. The ligand of paragraph 1, wherein the IL4Ra comprises mutations I75V and Q576R in SEQ ID NO: 67 and optionally the disease is asthma.

The ligand of paragraph 1 or 2, wherein the nucleotide sequence of (ii) comprises nucleotide mutation −3223T (dB SNP numbering).

The ligand of any preceding paragraph, wherein each said human VH gene segment comprises SEQ ID NO: 39.

3. The ligand of any preceding paragraph, wherein the VH gene segment comprised by said human is a germline VH gene segment.
4. The ligand of any preceding paragraph, said method comprising, before said administering, selecting a human comprising said nucleotide sequence of (ii), wherein the human is the human of paragraph 1.
5. The ligand of any preceding paragraph, wherein the human has been determined to comprise the nucleotide sequence that encodes an IL4Ra protein comprising said mutation selected from the group consisting of I75V, E400A, C431R, S503P, Q576R and S752A in SEQ ID NO: 67 and/or an IL4Ra protein comprising said mutation selected from the group consisting of I75V, E400A, C431R, S503P, Q576R and S752A in SEQ ID NO: 67.
6. The ligand of any preceding paragraph, said method comprising the step of determining that the human comprises (a) the nucleotide sequence that encodes an IL4Ra protein comprising said mutation selected from the group consisting of I75V, E400A, C431R, S503P, Q576R and S752A in SEQ ID NO: 67 and/or (b) an IL4Ra protein comprising said mutation said mutation selected from the group consisting of I75V, E400A, C431R, S503P, Q576R and S752A in SEQ ID NO: 67, optionally, wherein the determining step is performed before administration of the antibody to the human.
7. The ligand of paragraph 8, wherein the step of determining comprises assaying a biological sample from the human for a nucleotide sequence encoding a IL4Ra protein comprising said mutation selected from the group consisting of I75V, E400A, C431R, S503P, Q576R and S752A in SEQ ID NO: 67.
8. The ligand of paragraph 9, wherein the assaying comprises contacting the biological sample with at least one oligonucleotide probe comprising a sequence of at least 10 contiguous nucleotides of a nucleotide sequence encoding an IL4Ra protein comprising said mutation selected from the group consisting of I75V, E400A, C431R, S503P, Q576R and S752A in SEQ ID NO: 67 or comprising an antisense sequence of said contiguous nucleotides, wherein said sequence of contiguous nucleotides comprises a nucleotide sequence encoding said mutation selected from the group consisting of I75V, E400A, C431R, S503P, Q576R and S752A in SEQ ID NO: 67, thereby forming a complex when at least one nucleotide sequence encoding the IL4Ra protein comprising said mutation selected from the group consisting of I75V, E400A, C431R, S503P, Q576R and S752A in SEQ ID NO: 67 is present; and
   detecting the presence or absence of the complex, wherein detecting the presence of the complex determines that the human comprises the IL4Ra protein comprising said mutation selected from the group consisting of I75V, E400A, C431R, S503P, Q576R and S752A in SEQ ID NO: 67.
9. The ligand of paragraph 9, wherein the assaying comprises nucleic acid amplification and optionally one or more methods selected from sequencing, next generation sequencing, nucleic acid hybridization, and allele-specific amplification and/or wherein the assaying is performed in a multiplex format.

10. The ligand of paragraph 9 or 11, wherein said biological sample comprises serum, blood, feces, tissue, a cell, urine and/or saliva of said human.
11. The ligand of any preceding paragraph, wherein said human is indicated as heterozygous for a nucleotide sequence encoding the IL4Ra protein comprising said mutation selected from the group consisting of I75V, E400A, C431R, S503P, Q576R and S752A in SEQ ID NO: 67, optionally, wherein said human is further indicated as comprising the nucleotide sequence of SEQ ID NO: 68, or said human is indicated as homozygous for a nucleotide sequence encoding the IL4Ra protein comprising said mutation selected from the group consisting of I75V, E400A, C431R, S503P, Q576R and S752A in SEQ ID NO: 67.
12. The ligand of any preceding paragraph, wherein said human is or has been further determined to be substantially resistant to an asthma treatment.
13. The ligand of any preceding paragraph, wherein said human is receiving or has received an asthma treatment or has reduced responsiveness to an asthma treatment.
14. The ligand of any preceding paragraph, wherein said disease or condition is an inflammatory disease or condition; an atopic disease or condition; a respiratory disease or condition; a disease or condition associated with elevated IgE; or a disease or condition associated with elevated IL-4 and/or IL-13 activity.
15. The ligand of any preceding paragraph, wherein said disease or condition is selected from the group consisting of an airway inflammatory disease or condition, chronic obstructive pulmonary disease, asthma, pneumonia, hypersensitivity pneumonitis, pulmonary infiltrate with eosinophilia, environmental lung disease, pneumonia, bronchiectasis, cystic fibrosis, interstitial lung disease, primary pulmonary hypertension, pulmonary thromboembolism, disorders of the pleura, disorders of the mediastinum, disorders of the diaphragm, hypoventilation, hyperventilation, sleep apnea, acute respiratory distress syndrome, mesothelioma, sarcoma, graft rejection, graft versus host disease, lung cancer, allergic rhinitis, allergy, asbestosis, aspergilloma, aspergillosis, bronchiectasis, chronic bronchitis, emphysema, eosinophilic pneumonia, idiopathic pulmonary fibrosis, invasive pneumococcal disease, influenza, nontuberculous mycobacteria, pleural effusion, pneumoconiosis, pneumocytosis, pneumonia, pulmonary actinomycosis, pulmonary alveolar proteinosis, pulmonary anthrax, pulmonary edema, pulmonary embolus, pulmonary inflammation, pulmonary histiocytosis X, pulmonary hypertension, pulmonary nocardiosis, pulmonary tuberculosis, pulmonary veno-occlusive disease, rheumatoid lung disease, sarcoidosis, and Wegener's granulomatosis.
16. The ligand of any preceding paragraph, wherein said human has been diagnosed with at least one condition selected from the group consisting of an airway inflammatory disease or condition, chronic obstructive pulmonary disease, asthma, pneumonia, hypersensitivity pneumonitis, pulmonary infiltrate with eosinophilia, environmental lung disease, pneumonia, bronchiectasis, cystic fibrosis, interstitial lung disease, primary pulmonary hypertension, pulmonary thromboembolism, disorders of the pleura, disorders of the mediastinum, disorders of the diaphragm, hypoventilation, hyperventilation, sleep apnea, acute respiratory distress syndrome, mesothelioma, sarcoma, graft rejection, graft versus host disease, lung cancer, allergic rhinitis, allergy, asbestosis, aspergilloma, aspergillosis, bronchiectasis, chronic bronchitis, emphysema, eosinophilic pneumonia, idiopathic pulmonary fibrosis, invasive pneumococcal disease, influenza, nontuberculous mycobacteria, pleural effusion, pneumoconiosis, pneumocytosis, pneumonia, pulmonary actinomycosis, pulmonary alveolar proteinosis, pulmonary anthrax, pulmonary edema, pulmonary embolus, pulmonary inflammation, pulmonary histiocytosis X, pulmonary hypertension, pulmonary nocardiosis, pulmonary tuberculosis, pulmonary veno-occlusive disease, rheumatoid lung disease, sarcoidosis, and Wegener's granulomatosis.
17. The ligand of any preceding paragraph, wherein said antibody or antibody fragment treats or reduces the risk in said human of at least one condition selected from the group consisting of an airway inflammatory disease or condition, chronic obstructive pulmonary disease, asthma, pneumonia, hypersensitivity pneumonitis, pulmonary infiltrate with eosinophilia, environmental lung disease, pneumonia, bronchiectasis, cystic fibrosis, interstitial lung disease, primary pulmonary hypertension, pulmonary thromboembolism, disorders of the pleura, disorders of the mediastinum, disorders of the diaphragm, hypoventilation, hyperventilation, sleep apnea, acute respiratory distress syndrome, mesothelioma, sarcoma, graft rejection, graft versus host disease, lung cancer, allergic rhinitis, allergy, asbestosis, aspergilloma, aspergillosis, bronchiectasis, chronic bronchitis, emphysema, eosinophilic pneumonia, idiopathic pulmonary fibrosis, invasive pneumococcal disease, influenza, nontuberculous mycobacteria, pleural effusion, pneumoconiosis, pneumocytosis, pneumonia, pulmonary actinomycosis, pulmonary alveolar proteinosis, pulmonary anthrax, pulmonary edema, pulmonary embolus, pulmonary inflammation, pulmonary histiocytosis X, pulmonary hypertension, pulmonary nocardiosis, pulmonary tuberculosis, pulmonary veno-occlusive disease, rheumatoid lung disease, sarcoidosis, and Wegener's granulomatosis
18. The ligand of any preceding paragraph, wherein the nucleotide sequence comprises one or more SNPs selected from the group consisting of rs1805010, rs1805011, rs1805012, rs1805015, rs1801275 and rs1805016.
19. The ligand of any preceding paragraph, wherein said antibody or antibody fragment is for inhaled, intravenous or subcutaneous administration and/or is comprised in an inhalable or injectable preparation.
20. The ligand of any preceding paragraph, wherein the VH domain comprises the amino acid sequence of SEQ ID NO: 69.

Methods with C Region Tailoring

1. A method of treating or reducing the risk of an IL4Ra-mediated disease or condition in a human in need thereof, the method comprising administering to said human a ligand (eg, an antibody or antibody fragment) that specifically binds a human IL4Ra protein that comprises a mutation selected from the group consisting of I75V, E400A, C431R, S503P, Q576R and S752A in SEQ ID NO: 67;
    wherein the ligand comprises a human gamma-4 heavy chain constant region that comprises a Leu at position 189 shown in SEQ ID NO: 73 or an Arg at position 289 shown in SEQ ID NO: 73 and wherein said human comprises (i) an IGHG4*01 human heavy chain constant region gene segment, or the human expresses antibodies comprising human gamma-4 heavy chain constant regions comprising a Leu at position 189 shown in SEQ ID NO: 73 or an Arg at position 289 shown in SEQ ID NO: 73; and
    wherein (ii) said human comprises a nucleotide sequence encoding said IL4RA protein comprising said mutation selected from the group consisting of I75V, E400A, C431R, S503P, Q576R and S752A in SEQ ID NO: 67.

In an alternative, clause 1 provides:—

A method of targeting IL4Ra in a human, the method comprising administering to said human a ligand (eg, an antibody or antibody fragment) that specifically binds a human IL4Ra protein that comprises a mutation selected from the group consisting of I75V, E400A, C431R, S503P, Q576R and S752A in SEQ ID NO: 67;

wherein the ligand comprises a human gamma-4 heavy chain constant region that comprises a Leu at position 189 shown in SEQ ID NO: 73 or an Arg at position 289 shown in SEQ ID NO: 73 and wherein said human comprises (i) an IGHG4*01 human heavy chain constant region gene segment, or the human expresses antibodies comprising human gamma-4 heavy chain constant regions comprising a Leu at position 189 shown in SEQ ID NO: 73 or an Arg at position 289 shown in SEQ ID NO: 73; and wherein (ii) said human comprises a nucleotide sequence encoding said IL4RA protein comprising said mutation selected from the group consisting of I75V, E400A, C431R, S503P, Q576R and S752A in SEQ ID NO: 67.

In an example, the human is suffering from or at risk of an IL4Ra-mediated disease or condition.

In an example, the method treats or reduces the risk of an IL4Ra-mediated disease or condition in the human.

In an example of the method or ligand of the invention, the IL4Ra comprises mutation I75V.

In an example of the method or ligand of the invention, the IL4Ra comprises mutation E400A.

In an example of the method or ligand of the invention, the IL4Ra comprises mutation C431R.

In an example of the method or ligand of the invention, the IL4Ra comprises mutation S503P.

In an example of the method or ligand of the invention, the IL4Ra comprises mutation Q576R.

In an example of the method or ligand of the invention, the IL4Ra comprises mutation S752A.

2. The method of clause 1, wherein the IL4Ra comprises mutations I75V and Q576R in SEQ ID NO: 67 and optionally the disease is asthma.

3. The method of clause 1 or 2, wherein the nucleotide sequence of (ii) comprises nucleotide mutation −3223T (dB SNP numbering).

4. The method of any preceding clause, wherein said human gamma-4 heavy chain constant region that comprises SEQ ID NO: 73.

5. The method of any preceding clause, wherein the human expresses antibodies comprising human IGHG4*01 heavy chain constant regions.

6. The method of any preceding clause comprising, before said administering, selecting a human comprising said nucleotide sequence of (ii), wherein the human is the human of clause 1.

7. The method of any preceding clause, wherein the human has been determined to comprise the nucleotide sequence that encodes an IL4Ra protein comprising said mutation selected from the group consisting of I75V, E400A, C431R, S503P, Q576R and S752A in SEQ ID NO: 67 and/or an IL4Ra protein comprising said mutation selected from the group consisting of I75V, E400A, C431R, S503P, Q576R and S752A in SEQ ID NO: 67.

8. The method of any preceding clause, comprising the step of determining that the human comprises (a) the nucleotide sequence that encodes an IL4Ra protein comprising said mutation selected from the group consisting of I75V, E400A, C431R, S503P, Q576R and S752A in SEQ ID NO: 67 and/or (b) an IL4Ra protein comprising said mutation said mutation selected from the group consisting of I75V, E400A, C431R, S503P, Q576R and S752A in SEQ ID NO: 67, optionally, wherein the determining step is performed before administration of the antibody to the human.

9. The method of clause 8, wherein the step of determining comprises assaying a biological sample from the human for a nucleotide sequence encoding a IL4Ra protein comprising said mutation selected from the group consisting of I75V, E400A, C431R, S503P, Q576R and S752A in SEQ ID NO: 67.

10. The method of clause 9, wherein the assaying comprises contacting the biological sample with at least one oligonucleotide probe comprising a sequence of at least 10 contiguous nucleotides of a nucleotide sequence encoding an IL4Ra protein comprising said mutation selected from the group consisting of I75V, E400A, C431R, S503P, Q576R and S752A in SEQ ID NO: 67 or comprising an antisense sequence of said contiguous nucleotides, wherein said sequence of contiguous nucleotides comprises a nucleotide sequence encoding said mutation selected from the group consisting of I75V, E400A, C431R, S503P, Q576R and S752A in SEQ ID NO: 67, thereby forming a complex when at least one nucleotide sequence encoding the IL4Ra protein comprising said mutation selected from the group consisting of I75V, E400A, C431R, S503P, Q576R and S752A in SEQ ID NO: 67 is present; and detecting the presence or absence of the complex, wherein detecting the presence of the complex determines that the human comprises the IL4Ra protein comprising said mutation selected from the group consisting of I75V, E400A, C431R, S503P, Q576R and S752A in SEQ ID NO: 67.

11. The method of clause 9, wherein the assaying comprises nucleic acid amplification and optionally one or more methods selected from sequencing, next generation sequencing, nucleic acid hybridization, and allele-specific amplification and/or wherein the assaying is performed in a multiplex format.

12. The method of clause 9 or 11, wherein said biological sample comprises serum, blood, feces, tissue, a cell, urine and/or saliva of said human.

13. The method of any preceding clause, wherein said human is indicated as heterozygous for a nucleotide sequence encoding the IL4Ra protein comprising said mutation selected from the group consisting of I75V, E400A, C431R, S503P, Q576R and S752A in SEQ ID NO: 67, optionally, wherein said human is further indicated as comprising the nucleotide sequence of SEQ ID NO: 68, or said human is indicated as homozygous for a nucleotide sequence encoding the IL4Ra protein comprising said mutation selected from the group consisting of I75V, E400A, C431R, S503P, Q576R and S752A in SEQ ID NO: 67.

14. The method of any preceding clause, wherein said human is or has been further determined to be substantially resistant to an asthma treatment.

15. The method of any preceding clause, wherein said human is receiving or has received an asthma treatment or has reduced responsiveness to an asthma treatment.

16. The method of any preceding clause, wherein said disease or condition is an inflammatory disease or condition; an atopic disease or condition; a respiratory disease or condition; a disease or condition associated with elevated IgE; or a disease or condition associated with elevated IL-4 and/or IL-13 activity.

17. The method of any preceding clause, wherein said disease or condition is selected from the group consisting of an airway inflammatory disease or condition, chronic obstructive pulmonary disease, asthma, pneumonia, hypersensitivity pneumonitis, pulmonary infiltrate with eosinophilia, environmental lung disease, pneumonia, bronchiectasis, cystic fibrosis, interstitial lung disease, primary pulmonary hypertension, pulmonary thromboembolism, disorders of the pleura, disorders of the mediastinum, disorders of the diaphragm, hypoventilation, hyperventilation, sleep apnea, acute respiratory distress syndrome, mesothelioma, sarcoma, graft rejection, graft versus host disease, lung cancer, allergic rhinitis, allergy, asbestosis, aspergilloma, aspergillosis, bronchiectasis, chronic bronchitis, emphysema, eosinophilic pneumonia, idiopathic pulmonary fibrosis, invasive pneumococcal disease, influenza, nontuberculous mycobacteria, pleural effusion, pneumoconiosis, pneumocytosis, pneumonia, pulmonary actinomycosis, pulmonary alveolar proteinosis, pulmonary anthrax, pulmonary edema, pulmonary embolus, pulmonary inflammation, pulmonary histiocytosis X, pulmonary hypertension, pulmonary nocardiosis, pulmonary tuberculosis, pulmonary veno-occlusive disease, rheumatoid lung disease, sarcoidosis, and Wegener's granulomatosis.

18. The method of any preceding clause, wherein said human has been diagnosed with at least one condition selected from the group consisting of an airway inflammatory disease or condition, chronic obstructive pulmonary disease, asthma, pneumonia, hypersensitivity pneumonitis, pulmonary infiltrate with eosinophilia, environmental lung disease, pneumonia, bronchiectasis, cystic fibrosis, interstitial lung disease, primary pulmonary hypertension, pulmonary thromboembolism, disorders of the pleura, disorders of the mediastinum, disorders of the diaphragm, hypoventilation, hyperventilation, sleep apnea, acute respiratory distress syndrome, mesothelioma, sarcoma, graft rejection, graft versus host disease, lung cancer, allergic rhinitis, allergy, asbestosis, aspergilloma, aspergillosis, bronchiectasis, chronic bronchitis, emphysema, eosinophilic pneumonia, idiopathic pulmonary fibrosis, invasive pneumococcal disease, influenza, nontuberculous mycobacteria, pleural effusion, pneumoconiosis, pneumocytosis, pneumonia, pulmonary actinomycosis, pulmonary alveolar proteinosis, pulmonary anthrax, pulmonary edema, pulmonary embolus, pulmonary inflammation, pulmonary histiocytosis X, pulmonary hypertension, pulmonary nocardiosis, pulmonary tuberculosis, pulmonary veno-occlusive disease, rheumatoid lung disease, sarcoidosis, and Wegener's granulomatosis.

19. The method of any preceding clause, wherein said antibody or antibody fragment treats or reduces the risk in said human of at least one condition selected from the group consisting of an airway inflammatory disease or condition, chronic obstructive pulmonary disease, asthma, pneumonia, hypersensitivity pneumonitis, pulmonary infiltrate with eosinophilia, environmental lung disease, pneumonia, bronchiectasis, cystic fibrosis, interstitial lung disease, primary pulmonary hypertension, pulmonary thromboembolism, disorders of the pleura, disorders of the mediastinum, disorders of the diaphragm, hypoventilation, hyperventilation, sleep apnea, acute respiratory distress syndrome, mesothelioma, sarcoma, graft rejection, graft versus host disease, lung cancer, allergic rhinitis, allergy, asbestosis, aspergilloma, aspergillosis, bronchiectasis, chronic bronchitis, emphysema, eosinophilic pneumonia, idiopathic pulmonary fibrosis, invasive pneumococcal disease, influenza, nontuberculous mycobacteria, pleural effusion, pneumoconiosis, pneumocytosis, pneumonia, pulmonary actinomycosis, pulmonary alveolar proteinosis, pulmonary anthrax, pulmonary edema, pulmonary embolus, pulmonary inflammation, pulmonary histiocytosis X, pulmonary hypertension, pulmonary nocardiosis, pulmonary tuberculosis, pulmonary veno-occlusive disease, rheumatoid lung disease, sarcoidosis, and Wegener's granulomatosis 20. The method of any preceding clause, wherein the nucleotide sequence comprises one or more SNPs selected from the group consisting of rs1805010, rs1805011, rs1805012, rs1805015, rs1801275 and rs1805016.

21. The method of any preceding clause, wherein said antibody or antibody fragment is administered by inhaled, intravenous or subcutaneous administration and/or is comprised in an inhalable or injectable preparation.

Ligands with Constant Region Tailoring

1. A ligand (eg, an antibody or antibody fragment) for use in a method of treating or reducing the risk of an IL4Ra-mediated disease or condition (eg, asthma) in a human in need thereof, wherein the ligand specifically binds a human IL4RA protein that comprises a mutation selected from the group consisting of I75V, E400A, C431R, S503P, Q576R and S752A in SEQ ID NO: 67; wherein (i) the ligand comprises a human gamma-4 heavy chain constant region that comprises a Leu at position 189 shown in SEQ ID NO: 73 or an Arg at position 289 shown in SEQ ID NO: 73 and wherein said human comprises (i) an IGHG4*01 human heavy chain constant region gene segment, or the human expresses antibodies comprising human gamma-4 heavy chain constant regions comprising a Leu at position 189 shown in SEQ ID NO: 73 or an Arg at position 289 shown in SEQ ID NO: 73; and wherein (ii) said human comprises a nucleotide sequence encoding said IL4RA protein comprising said mutation selected from the group consisting of I75V, E400A, C431R, S503P, Q576R and S752A in SEQ ID NO: 67.

In an alternative, paragraph 1 provides:—

A ligand (eg, an antibody or antibody fragment) for use in a method of targeting IL4Ra in a human, wherein the ligand specifically binds a human IL4RA protein that comprises a mutation selected from the group consisting of I75V, E400A, C431R, S503P, Q576R and S752A in SEQ ID NO: 67; wherein (i) the ligand comprises a human gamma-4 heavy chain constant region that comprises a Leu at position 189 shown in SEQ ID NO: 73 or an Arg at position 289 shown in SEQ ID NO: 73 and wherein said human comprises (i) an IGHG4*01 human heavy chain constant region gene segment, or the human expresses antibodies comprising human gamma-4 heavy chain constant regions comprising a Leu at position 189 shown in SEQ ID NO: 73 or an Arg at position 289 shown in SEQ ID NO: 73; and wherein (ii) said human comprises a nucleotide sequence encoding said IL4RA protein comprising said mutation selected from the group consisting of I75V, E400A, C431R, S503P, Q576R and S752A in SEQ ID NO: 67.

In an example, the human is suffering from or at risk of an IL4Ra-mediated disease or condition.

In an example, the method treats or reduces the risk of an IL4Ra-mediated disease or condition in the human.

2. The ligand of paragraph 1, wherein the IL4Ra comprises mutations I75V and Q576R in SEQ ID NO: 67 and optionally the disease is asthma.

3. The ligand of paragraph 1 or 2, wherein the nucleotide sequence of (ii) comprises nucleotide mutation −3223T (dB SNP numbering).

4. The ligand of any preceding paragraph, wherein said human gamma-4 heavy chain constant region that comprises SEQ ID NO: 73.

5. The ligand of any preceding paragraph, wherein the human expresses antibodies comprising human IGHG4*01 heavy chain constant regions.

6. The ligand of any preceding paragraph, said method comprising, before said administering, selecting a human comprising said nucleotide sequence of (ii), wherein the human is the human of paragraph 1.

7. The ligand of any preceding paragraph, wherein the human has been determined to comprise the nucleotide sequence that encodes an IL4Ra protein comprising said mutation selected from the group consisting of I75V, E400A, C431R, S503P, Q576R and S752A in SEQ ID NO: 67 and/or an IL4Ra protein comprising said mutation selected from the group consisting of I75V, E400A, C431R, S503P, Q576R and S752A in SEQ ID NO: 67.

8. The ligand of any preceding paragraph, said method comprising the step of determining that the human comprises (a) the nucleotide sequence that encodes an IL4Ra protein comprising said mutation selected from the group consisting of I75V, E400A, C431R, S503P, Q576R and S752A in SEQ ID NO: 67 and/or (b) an IL4Ra protein comprising said mutation said mutation selected from the group consisting of I75V, E400A, C431R, S503P, Q576R and S752A in SEQ ID NO: 67, optionally, wherein the determining step is performed before administration of the antibody to the human.

9. The ligand of paragraph 8, wherein the step of determining comprises assaying a biological sample from the human for a nucleotide sequence encoding a IL4Ra protein comprising said mutation selected from the group consisting of I75V, E400A, C431R, S503P, Q576R and S752A in SEQ ID NO: 67.

10. The ligand of paragraph 9, wherein the assaying comprises
    contacting the biological sample with at least one oligonucleotide probe comprising a sequence of at least 10 contiguous nucleotides of a nucleotide sequence encoding an IL4Ra protein comprising said mutation selected from the group consisting of I75V, E400A, C431R, S503P, Q576R and S752A in SEQ ID NO: 67 or comprising an antisense sequence of said contiguous nucleotides, wherein said sequence of contiguous nucleotides comprises a nucleotide sequence encoding said mutation selected from the group consisting of I75V, E400A, C431R, S503P, Q576R and S752A in SEQ ID NO: 67, thereby forming a complex when at least one nucleotide sequence encoding the IL4Ra protein comprising said mutation selected from the group consisting of I75V, E400A, C431R, S503P, Q576R and S752A in SEQ ID NO: 67 is present; and
    detecting the presence or absence of the complex, wherein detecting the presence of the complex determines that the human comprises the IL4Ra protein comprising said mutation selected from the group consisting of I75V, E400A, C431R, S503P, Q576R and S752A in SEQ ID NO: 67.

11. The ligand of paragraph 9, wherein the assaying comprises nucleic acid amplification and optionally one or more methods selected from sequencing, next generation sequencing, nucleic acid hybridization, and allele-specific amplification and/or wherein the assaying is performed in a multiplex format.

12. The ligand of paragraph 9 or 11, wherein said biological sample comprises serum, blood, feces, tissue, a cell, urine and/or saliva of said human.

13. The ligand of any preceding paragraph, wherein said human is indicated as heterozygous for a nucleotide sequence encoding the IL4Ra protein comprising said mutation selected from the group consisting of I75V, E400A, C431R, S503P, Q576R and S752A in SEQ ID NO: 67, optionally, wherein said human is further indicated as comprising the nucleotide sequence of SEQ ID NO: 68, or said human is indicated as homozygous for a nucleotide sequence encoding the IL4Ra protein comprising said mutation selected from the group consisting of I75V, E400A, C431R, S503P, Q576R and S752A in SEQ ID NO: 67.

14. The ligand of any preceding paragraph, wherein said human is or has been further determined to be substantially resistant to an asthma treatment.

15. The ligand of any preceding paragraph, wherein said human is receiving or has received an asthma treatment or has reduced responsiveness to an asthma treatment.

16. The ligand of any preceding paragraph, wherein said disease or condition is an inflammatory disease or condition; an atopic disease or condition; a respiratory disease or condition; a disease or condition associated with elevated IgE; or a disease or condition associated with elevated IL-4 and/or IL-13 activity.

17. The ligand of any preceding paragraph, wherein said disease or condition is selected from the group consisting of an airway inflammatory disease or condition, chronic obstructive pulmonary disease, asthma, pneumonia, hypersensitivity pneumonitis, pulmonary infiltrate with eosinophilia, environmental lung disease, pneumonia, bronchiectasis, cystic fibrosis, interstitial lung disease, primary pulmonary hypertension, pulmonary thromboembolism, disorders of the pleura, disorders of the mediastinum, disorders of the diaphragm, hypoventilation, hyperventilation, sleep apnea, acute respiratory distress syndrome, mesothelioma, sarcoma, graft rejection, graft versus host disease, lung cancer, allergic rhinitis, allergy, asbestosis, aspergilloma, aspergillosis, bronchiectasis, chronic bronchitis, emphysema, eosinophilic pneumonia, idiopathic pulmonary fibrosis, invasive pneumococcal disease, influenza, nontuberculous mycobacteria, pleural effusion, pneumoconiosis, pneumocytosis, pneumonia, pulmonary actinomycosis, pulmonary alveolar proteinosis, pulmonary anthrax, pulmonary edema, pulmonary embolus, pulmonary inflammation, pulmonary histiocytosis X, pulmonary hypertension, pulmonary nocardiosis, pulmonary tuberculosis, pulmonary veno-occlusive disease, rheumatoid lung disease, sarcoidosis, and Wegener's granulomatosis.

18. The ligand of any preceding paragraph, wherein said human has been diagnosed with at least one condition selected from the group consisting of an airway inflammatory disease or condition, chronic obstructive pulmonary disease, asthma, pneumonia, hypersensitivity pneumonitis, pulmonary infiltrate with eosinophilia, environmental lung disease, pneumonia, bronchiectasis, cystic fibrosis, interstitial lung disease, primary pulmonary hypertension, pulmonary thromboembolism, disorders of the pleura, disorders of the mediastinum, disorders of the diaphragm, hypoventilation, hyperventilation, sleep apnea, acute respiratory distress syndrome, mesothelioma, sarcoma, graft rejection, graft versus host disease, lung cancer, allergic rhinitis, allergy, asbestosis, aspergilloma, aspergillosis, bronchiectasis, chronic bronchitis, emphysema, eosinophilic pneumonia, idiopathic pulmonary fibrosis, invasive pneumococcal disease, influenza, nontuberculous mycobacteria, pleural effusion, pneumoconiosis, pneumocytosis, pneumonia, pulmonary actinomycosis, pulmonary alveolar proteinosis, pulmonary anthrax, pulmonary edema, pulmonary embolus, pulmonary inflammation, pulmonary histiocytosis X, pulmonary hypertension, pulmonary nocardiosis, pulmonary tuberculosis, pulmonary veno-occlusive disease, rheumatoid lung disease, sarcoidosis, and Wegener's granulomatosis.

19. The ligand of any preceding paragraph, wherein said antibody or antibody fragment treats or reduces the risk in said human of at least one condition selected from the group consisting of an airway inflammatory disease or condition, chronic obstructive pulmonary disease, asthma, pneumonia, hypersensitivity pneumonitis, pulmonary infiltrate with eosinophilia, environmental lung disease, pneumonia, bronchiectasis, cystic fibrosis, interstitial lung disease, primary pulmonary hypertension, pulmonary thromboembolism, disorders of the pleura, disorders of the mediastinum, disorders of the diaphragm, hypoventilation, hyperventilation, sleep apnea, acute respiratory distress syndrome, mesothelioma, sarcoma, graft rejection, graft versus host disease, lung cancer, allergic rhinitis, allergy, asbestosis, aspergilloma, aspergillosis, bronchiectasis, chronic bronchitis, emphysema, eosinophilic pneumonia, idiopathic pulmonary fibrosis, invasive pneumococcal disease, influenza, nontuberculous mycobacteria, pleural effusion, pneumoconiosis, pneumocytosis, pneumonia, pulmonary actinomycosis, pulmonary alveolar proteinosis, pulmonary anthrax, pulmonary edema, pulmonary embolus, pulmonary inflammation, pulmonary histiocytosis X, pulmonary hypertension, pulmonary nocardiosis, pulmonary tuberculosis, pulmonary veno-occlusive disease, rheumatoid lung disease, sarcoidosis, and Wegener's granulomatosis 20. The ligand of any preceding paragraph, wherein the nucleotide sequence comprises one or more SNPs selected from the group consisting of rs1805010, rs1805011, rs1805012, rs1805015, rs1801275 and rs1805016.

21. The ligand of any preceding paragraph, wherein said antibody or antibody fragment is for inhaled, intravenous or subcutaneous administration and/or is comprised in an inhalable or injectable preparation.

In an example of any other example or embodiment, clause or paragraph relating to IL4Ra, the IL4Ra mutation is 75V and the human is of AFR or ASN ancestry, eg, the ancestry of the human is selected from ASW, LWK, CHS or JPT. All of these ancestries have greater than the average of 47% frequency for 75V.

In an example of any other example or embodiment, clause or paragraph relating to IL4Ra, the IL4Ra mutation is 400A and the human is of AFR ancestry, eg, the ancestry of the human is selected from ASW, LWK and YRI. All of these ancestries have greater than the average frequency for 400A.

In an example of any other example or embodiment, clause or paragraph relating to IL4Ra, the IL4Ra mutation is 431R and the human is of AFR or AMR ancestry, eg, the ancestry of the human is selected from YRI, CLM, MXL, PUR or CEU. All of these ancestries have greater than the average frequency for 431R.

In an example of any other example or embodiment, clause or paragraph relating to IL4Ra, the IL4Ra mutation is 752A and the human is of AFR ancestry, eg, the ancestry of the human is selected from ASW, LWK and YRI. All of these ancestries have 37-39% frequency, which is greater than the average frequency for 752A.

Frequencies are with reference to the 1000 Genomes database (version 20110521) here.

In an example of any other example or embodiment, clause or paragraph relating to IL4Ra, the IL4Ra mutation is 75V and the human is of AFR or ASN ancestry, eg, the ancestry of the human is selected from ASW, LWK, CHS or JPT. All of these ancestries have greater than the average of 47% frequency for 75V.

Example 3

Nav1.7 (SCN9A; ETHA; FEB3B; GEFSP7; NE-NA; NENA; PN1; SFNP)

Reference is made to J Clin Invest. 2007 December; 117 (12):3603-9, "Mutations in sodium-channel gene SCN9A cause a spectrum of human genetic pain disorders", Drenth J P & Waxman S G (incorporated herein by reference). Voltage-gated sodium channels play a critical role in the generation and conduction of action potentials and are thus important for electrical signalling by most excitable cells. Sodium channels are integral membrane proteins and are comprised of a large a subunit, which forms the voltage-sensitive and ion-selective pore, and smaller auxiliary β subunit(s) that can modulate the kinetics and voltage dependence of channel gating. To date, we know of 9 isoforms of the sodium-channel α subunit (Nav1.1-Nav1.9), each with a unique central and peripheral nervous system distribution. Four closely related sodium channels (Nav1.1, −1.2, −1.3, and −1.7) are encoded by a set of 4 genes (SCN1A, SCN2A, SCN3A, and SCN9A, respectively) located within a cluster on chromosome 2q24.3. Nav1.7 has a critical role in pain sensation. Furthermore, from KO studies and animal pain models, it would appear that Nav1.7 plays a major role in inflammatory pain.

Nav1.7 is located in peripheral neurons and plays an important role in action potential production in these cells. Recent genetic studies have identified Nav1.7 dysfunction in three different human pain disorders. Gain-of-function missense mutations in Nav1.7 have been shown to cause primary erythermalgia (PE) and paroxysmal extreme pain disorder (PEPD), while nonsense mutations in Nav1.7 result in loss of Nav1.7 function and a condition known as channelopathy-associated insensitivity to pain (CIP), a rare disorder in which affected individuals are unable to feel physical pain. Recent work has shown that different types of channelopathies (diseases caused by disturbed function of ion channel subunits or the proteins that regulate them), all involving the same Nav1.7 sodium channel, underlie these disorders.

Nav1.7 is encoded by SCN9A, a 113.5-kb gene comprising 26 exons (OMIM 603415) (FIG. 1A, Drenth & Waxman) The encoded sodium channel is composed of 1977 amino acids organized into 4 domains, each with 6 transmembrane segments, and is predominantly expressed in the dorsal root ganglion (DRG) neurons and sympathetic ganglion neurons (FIG. 1B, Drenth & Waxman) Immunohistochemical studies show that Nav1.7 is present at the distal ends of the wire-like projections of neurons known as neurites, close to the impulse trigger zone where neuronal firing is initiated. Interestingly, the large majority of DRG neurons that express Nav1.7 are pain sensing (nociceptive), suggesting a role for this sodium channel in the pathogenesis of pain.

Cell. 2014 Jun. 5; 157(6):1393-404. doi: 10.1016/j.cell.2014.03.064. Epub 2014 May 22; "A monoclonal antibody that targets a NaV1.7 channel voltage sensor for pain and itch relief", Lee J H et al and 2011 (both incorporated herein by reference) describe the generation of a monoclonal antibody against huma Nav1.7.

In an example, the invention provides a method of treating or reducing the risk of a Nav1.7-mediated disease or condition in a human in need thereof, the method comprising administering to said human a ligand (eg, an antibody or antibody fragment) that specifically binds a huma Nav1.7 protein. The invention also provides a corresponding ligand.

The present invention provides anti-Nav1.7 ligands; and Nav1.7-binding or targeting ligands as described herein. The ligands have a variety of utilities. Some of the ligands, for instance, are useful in specific binding assays, for genotyping or phenotyping humans, affinity purification of Nav1.7, in particular huma Nav1.7 or its ligands and in screening assays to identify other antagonists of Nav1.7 activity. Some of the ligands of the invention are useful for inhibiting Nav1.7-mediated activities.

Anti-Nav1.7 ligands (eg, antibodies and anti-sense RNA) have been developed based on targeting and neutralising so-called "wild-type" huma Nav1.7, which is a commonly-occurring form (see, eg, SEQ ID NO: 75). While such therapies are useful for human patients harbouring this form of huma Nav1.7, the inventor considered it useful to investigate the possibility of targeting rarer—but still naturally-occurring—forms of Nav1.7 amongst human populations. In this way, the inventor arrived at insight into the natural occurrences and distributions of rarer huma Nav1.7 forms that can serve as useful targets (at the protein or nucleic acid level) for human treatment, prophylaxis and diagnosis pertinent to diseases and conditions mediated or associated with NAV1.7 activity. This particularly provides for tailored therapies, prophylaxis and diagnosis in humans that are devoid of the common Nav1.7 gene or protein.

The skilled person will know that SNPs or other changes that translate into amino acid variation can cause variability in activity and/or conformation of human targets to be addressed. This has spawned great interest in personalized medicine where genotyping and knowledge of protein and nucleotide variability is used to more effectively tailor medicines and diagnosis of patients. The invention, therefore, provides for tailored pharmaceuticals and testing that specifically addresses rarer Nav1.7 polymorphic variant forms. Such forms or "alleles" (at the nucleotide level), comprise one or more changes at the nucleotide and amino acid levels from the corresponding common form nucleotide and amino acids sequences, ie, there are one or more non-synonymous (aka "missense") changes at the nucleotide level that translate into one or more corresponding changes in the protein target in humans.

Furthermore, the inventor surprisingly realised that the rarer natural forms, although present in humans at much lower frequencies than the common form, nevertheless are represented in multiple and ethnically-diverse human populations and usually with many human examples per represented ethnic population. Thus, the inventor realised that targeting such rarer forms would provide for effective treatment, prophylaxis or diagnosis across many human ethnic populations, thereby extending the utility of the present invention.

With this realisation, the inventor saw that there is significant industrial and medical application for the invention in terms of guiding the choice of anti-Nav1.7 ligand for administration to human patients for therapy and/or prophylaxis of Nav1.7-mediated or associated diseases or conditions. In this way, the patient receives drugs and ligands that are tailored to their needs—as determined by the patient's genetic or phenotypic makeup. Hand-in-hand with this, the invention provides for the genotyping and/or phenotyping of patients in connection with such treatment, thereby allowing a proper match of drug to patient. This increases the chances of medical efficacy, reduces the likelihood of inferior treatment using drugs or ligands that are not matched to the patient (eg, poor efficacy and/or side-effects) and avoids pharmaceutical mis-prescription and waste.

In developing this thinking, in this non-limiting example the present inventor decided to determine a set of huma Nav1.7 variants on the basis of the following criteria, these being criteria that the inventor realised would provide for useful medical drugs and diagnostics to tailored need in the human population. The inventor selected variants having at least 3 of the 4 following criteria:—

Naturally-occurring huma Nav1.7 variation having a cumulative human allele frequency of 35% or less;

Naturally-occurring huma Nav1.7 variation having a total human genotype frequency of about 50% or less;

Naturally-occurring huma Nav1.7 variation found in many different human ethnic populations (using the standard categorisation of the 1000 Genomes Project; see Table 2 below); and Naturally-occurring huma Nav1.7 variation found in many individuals distributed across such many different ethnic populations.

On the basis of these criteria, the inventor identified variants listed in Table 12 (see Further Variants) below. The inventor's selection included, as an additional or alternative consideration, selection for nucleotide variation that produced amino acid variation in corresponding Nav1.7 forms (ie, non-synonymous variations), as opposed to silent variations that do not alter amino acid residues in the target protein.

In an example, the invention provides a method of treating or reducing the risk of a Nav1.7-mediated disease or condition in a human in need thereof, the method comprising administering to said human a ligand (eg, an antibody or antibody fragment) that specifically binds a huma Nav1.7 protein that comprises an amino acid selected from the group consisting of 136I, 216S, 241T, 395K, 848T, 858H, 858F, 863P, 1449V, 996C, 1298F, 1298D, 1299F, 1461T, 1462V, 1464I, 1627K, 277X (wherein X is an amino acid other than R), 328X (wherein X is an amino acid other than Y), 395K, 459X (wherein X is an amino acid other than S), 693 X (wherein X is an amino acid other than E), 767X (wherein X is an amino acid other than I), 830X (wherein X is an amino acid other than R), 897X (wherein X is an amino acid other than W), 1200L, 1235L, 1488X (wherein X is an amino acid other than R), 1659X (wherein X is an amino acid other than K), 1689X (wherein X is an amino acid other than W), 422D, 490N, 943L, 1002L, 1161W and 1919G. As explained further below, these amino acid variations are found in naturally-occurring Nav1.7 variants in humans found in many populations. Said human comprises a nucleotide sequence encoding said Nav1.7 protein comprising said amino acid selected from the group consisting of 136I, 216S, 241T, 395K, 848T, 858H, 858F, 863P, 1449V, 996C, 1298F, 1298D, 1299F, 1461T, 1462V, 1464I, 1627K, 277X (wherein X is an amino acid other than R), 328X (wherein X is an amino acid other than Y), 395K, 459X (wherein X is an amino acid other than S), 693 X (wherein X is an amino acid other than E), 767X (wherein X is an amino acid other than I), 830X (wherein X is an amino acid other than R), 897X (wherein X is an amino acid other than W), 1200L, 1235L, 1488X (wherein X is an amino acid other than R), 1659X (wherein X is an amino acid other than K), 1689X (wherein X is an amino acid other than W), 422D, 490N, 943L, 1002L, 1161W and 1919G.

For example, said amino acid is selected from the group consisting of any one of (a) to (e):— a) 136I, 216S, 241T, 395K, 848T, 858H, 858F, 863P and 1449V; or
b) 996C, 1298F, 1298D, 1299F, 1461T, 1462V, 14641 and 1627K; or
c) 277X (wherein X is an amino acid other than R), 328X (wherein X is an amino acid other than Y), 395K, 459X (wherein X is an amino acid other than S), 693 X (wherein X is an amino acid other than E), 767X (wherein X is an amino acid other than I), 830X (wherein X is an amino acid other than R), 897X (wherein X is an amino acid other than W), 1200L, 1235L, 1488X (wherein X is an amino acid other than R), 1659X (wherein X is an amino acid other than K) and 1689X (wherein X is an amino acid other than W); or
d) 395K, 1200L and 1235L; or
e) 422D, 490N, 943L, 1002L, 1161W and 1919G.

Amino acids (a)-(d) are discussed in Drenth & Waxman as being associated with pain conditions (either undesirable elevated or reduced pain). Thus, in one embodiment, the disease or condition is a pain disease or condition and the amino acid is selected from (a), (b), (c) or (d). Thus, in one embodiment, the disease or condition is an itching disease or condition and the amino acid is selected from (a), (b), (c) or (d). In an example, the disease is PE and the amino acid is selected from (a). In an example, the disease is PEPD and the amino acid is selected from (b). In an example, the disease is CIP and the amino acid is selected from (c) or (d). In an example, the disease or condition is a pain or itching disease or condition and the amino acid is selected from (e).

In one embodiment, the pain is chronic pain.

In one embodiment, the pain is neuropathic pain, eg, chronic neuropathic pain. For example, the pain is painful diabetic neuropathy (PDN), post-herpetic neuropathy (PHN) or trigeminal neuralgia (TN).

In an example, the pain is spinal cord injury pain, multiple sclerosis pain, phantom limb pain, post-stroke pain, chronic back pain, osteoarthritis pain, cancer-associated pain or HIV-associated pain.

In one embodiment, the pain is inflammatory pain, eg, chronic inflammatory pain.

In one embodiment, the disease or condition is a channelopathy or associated with a channelopathy.

In one embodiment, the disease or condition is selected from the group consisting of primary erythermalgia (PE), paroxysmal extreme pain disorder (PEPD) and channelopathy-associated insensitivity to pain (CIP).

Optionally, the NAV-mediated disease or condition is selected from any one of the following:
a. Neuropathic or neurogenic pain (for example arising from painful diabetic neuropathy (PDN), post-herpetic neuropathy (PHN), central neuropathy, peripheral neuropathy, trigeminal neuralgia (TN), anaesthesia dolorosa, spinal cord injuries, multiple sclerosis, phantom limb pain, hyperalgesia, hyperpathia, paresthesia, psychogenic pain, post-stroke pain and HIV-associated pain, back pain, chronic back pain, osteoarthritis, cancer, breakthrough pain, erythromelalgia [e.g. primary erythromelalgia], paroxysmal 30 extreme pain disorder, nerve compression and/or entrapment [such as carpal tunnel syndrome, tarsal tunnel syndrome, ulnar nerve entrapment, compression radiculopathy, radicular low back pain, spinal root lesions, spinal root compression, lumbar spinal stenosis, sciatic nerve compression, intercostal neuralgia], neuritis, pain from chemotherapy, congenital defect/channelopathy [e.g. channelopathy-associated insensitivity to pain and congenital insensitivity to pain] or chronic alcoholism [alcoholic polyneuropathy]);
b. inflammatory pain (such as osteoarthritis pain, chronic back pain, rheumatoid arthritis pain, cancer pain, breakthrough pain, pain associated with burns, encephalitis pain, bone fracture pain, neuritis pain, autoimmune disease pain, postoperative pain, dental pain, pain associated with bacterial infection, pain associated with radiotherapy, pain associated with gout and irritable bowel syndrome pain);
c. pain from trauma (such as from lacerations, incisions, burns, foreign bodies or bullet and/or shrapnel injuries, spinal cord injury, brachial plexus avulsion, nerve crush and/or entrapment (such as carpal tunnel syndrome, tarsal tunnel syndrome, ulnar nerve entrapment, compression radiculopathy, radicular low back pain, spinal root lesions, spinal root compression, lumbar spinal stenosis, sciatic nerve compression, intercostal neuralgia), nerve transection, post-operative pain, dental pain and toxic exposure);
d. pain from infection (such as post-herpetic neuropathy (PHN), HIV-associated pain small pox infection, encephalitis, herpes infection, and bacterial infection);
e. pain from malignancy (such as cancer pain, breakthrough pain, and nerve compression pain);
f. visceral pain (such as renal or ureteral colic, irritable bowel syndrome, angina or cardiac pain, cardiac arrhythmia, period pain, interstitial cystitis, rectal pain, pain associated with diarrhea, appendicitis, cholecystitis and pancreatitis);
g. metabolic or chronic disease pain (such as associated with multiple sclerosis, cancer pain, breakthrough pain, pain associated with gout, peripheral diabetic neuropathy, pain associated with chronic alcoholism [alcoholic polyneuropathy], uremia pain, pain associated with hypothyroidism and pain associated with vitamin deficiency);
h. headache pain (such as tension headache, migraine and cluster headache);
i. idiopathic pain (such as trigeminal neuralgia, a complex regional pain syndrome [e.g. complex regional pain syndrome I and/or complex regional pain syndrome II], allodynia or fibromyalgia);
j. respiratory pain (such as pain associated with asthma, airway hyper-reactivity in asthma, chronic cough, e.g. in asthma and/or chronic obstructive pulmonary disorder); or
k. other pain (such as pain associated with hormonal therapy, diabetes, hypothyroidism, epilepsy, ataxia, periodic paralysis, acute itch or chronic itch).

In an example, the NAV-mediated disease or condition is selected from painful diabetic neuropathy, post-herpetic neuropathy, trigeminal neuralgia, osteoarthritis, chronic back pain, nerve compression pain (e.g. sciatic nerve compression) or cancer pain; or is selected from migraine, post-operative pain and fibromyalgia.

In an example, the ligand of the invention comprises an anti-huma Nav1.7 binding site, wherein the binding site is a human or humanized binding site, eg, the binding site comprises or consists of a human or humanized antibody variable domain or plurality of variable domains (eg, human VH/VL binding site(s)). Additionally or alternatively, the ligand comprises one or more human antibody constant regions (eg, a human antibody CH1, CH2, CH3 (or all of these) or Fc). In an example, the ligand is an antibody that comprises human or humanized variable regions and human constant regions (eg, bearing one or more mutations to enhance or dampen Fc function in a human patient).

An example provides a ligand (eg, an antibody or antibody fragment) for treating or reducing the risk of a Nav1.7-mediated disease or condition in a human in need thereof, the method comprising administering to said human said ligand, wherein the ligand specifically binds a huma Nav1.7 protein that comprises an amino acid selected from the group consisting of 136I, 216S, 241T, 395K, 848T, 858H, 858F, 863P, 1449V, 996C, 1298F, 1298D, 1299F, 1461T, 1462V, 14641, 1627K, 277X (wherein X is an amino acid other than R), 328X (wherein X is an amino acid other than Y), 395K, 459X (wherein X is an amino acid other than S), 693 X (wherein X is an amino acid other than E), 767X (wherein X is an amino acid other than I), 830X (wherein X is an amino acid other than R), 897X (wherein X is an amino acid other than W), 1200L, 1235L, 1488X (wherein X is an amino acid other than R), 1659X (wherein X is an amino acid other than K), 1689X (wherein X is an amino acid other than W), 422D, 490N, 943L, 1002L, 1161W and 1919G. Said human comprises a nucleotide sequence encoding said Nav1.7 protein comprising said amino acid selected from the group consisting of 136I, 216S, 241T, 395K, 848T, 858H, 858F, 863P, 1449V, 996C, 1298F, 1298D, 1299F, 1461T, 1462V, 14641, 1627K, 277X (wherein X is an amino acid other than R), 328X (wherein X is an amino acid other than Y), 395K, 459X (wherein X is an amino acid other than S), 693 X (wherein X is an amino acid other than E), 767X (wherein X is an amino acid other than I), 830X (wherein X is an amino acid other than R), 897X (wherein X is an amino acid other than W), 1200L, 1235L, 1488X (wherein X is an amino acid other than R), 1659X (wherein X is an amino acid other than K), 1689X (wherein X is an amino acid other than W), 422D, 490N, 943L, 1002L, 1161W and 1919G.

In an example, the invention provides a method of targeting Nav1.7 in a human, the method comprising administering to said human a ligand (eg, an antibody or antibody fragment) that specifically binds a huma Nav1.7 protein that comprises an amino acid selected from the group consisting of 136I, 216S, 241T, 395K, 848T, 858H, 858F, 863P, 1449V, 996C, 1298F, 1298D, 1299F, 1461T, 1462V, 14641, 1627K, 277X (wherein X is an amino acid other than R), 328X (wherein X is an amino acid other than Y), 395K, 459X (wherein X is an amino acid other than S), 693 X (wherein X is an amino acid other than E), 767X (wherein X is an amino acid other than I), 830X (wherein X is an amino acid other than R), 897X (wherein X is an amino acid other than W), 1200L, 1235L, 1488X (wherein X is an amino acid other than R), 1659X (wherein X is an amino acid other than K), 1689X (wherein X is an amino acid other than W), 422D, 490N, 943L, 1002L, 1161W and 1919G. Said human comprises a nucleotide sequence encoding said Nav1.7 protein comprising said amino acid selected from the group consisting of 136I, 216S, 241T, 395K, 848T, 858H, 858F, 863P, 1449V, 996C, 1298F, 1298D, 1299F, 1461T, 1462V, 14641, 1627K, 277X (wherein X is an amino acid other than R), 328X (wherein X is an amino acid other than Y), 395K, 459X (wherein X is an amino acid other than S), 693 X (wherein X is an amino acid other than E), 767X (wherein X is an amino acid other than I), 830X (wherein X is an amino acid other than R), 897X (wherein X is an amino acid other than W), 1200L, 1235L, 1488X (wherein X is an amino acid other than R), 1659X (wherein X is an amino acid other than K), 1689X (wherein X is an amino acid other than W), 422D, 490N, 943L, 1002L, 1161W and 1919G. In an example, the human is suffering from or at risk of a Nav1.7-mediated disease or condition. In an example, the method treats or reduces the risk of a Nav1.7-mediated disease or condition in the human.

An example also provides a ligand (eg, an antibody or antibody fragment) for targeting Nav1.7 in a human, the method comprising administering to said human said ligand, wherein the ligand specifically binds a huma Nav1.7 protein that comprises an amino acid selected from the group consisting of 136I, 216S, 241T, 395K, 848T, 858H, 858F, 863P, 1449V, 996C, 1298F, 1298D, 1299F, 1461T, 1462V, 14641, 1627K, 277X (wherein X is an amino acid other than R), 328X (wherein X is an amino acid other than Y), 395K, 459X (wherein X is an amino acid other than S), 693 X (wherein X is an amino acid other than E), 767X (wherein X is an amino acid other than I), 830X (wherein X is an amino acid other than R), 897X (wherein X is an amino acid other than W), 1200L, 1235L, 1488X (wherein X is an amino acid other than R), 1659X (wherein X is an amino acid other than K), 1689X (wherein X is an amino acid other than W), 422D, 490N, 943L, 1002L, 1161W and 1919G. Said human comprises a nucleotide sequence encoding said Nav1.7 protein comprising said amino acid selected from the group consisting of 136I, 216S, 241T, 395K, 848T, 858H, 858F, 863P, 1449V, 996C, 1298F, 1298D, 1299F, 1461T, 1462V, 14641, 1627K, 277X (wherein X is an amino acid other than R), 328X (wherein X is an amino acid other than Y), 395K, 459X (wherein X is an amino acid other than S), 693 X (wherein X is an amino acid other than E), 767X (wherein X is an amino acid other than I), 830X (wherein X is an amino acid other than R), 897X (wherein X is an amino acid other than W), 1200L, 1235L, 1488X (wherein X is an amino acid other than R), 1659X (wherein X is an amino acid other than K), 1689X (wherein X is an amino acid other than W), 422D, 490N, 943L, 1002L, 1161W and 1919G. In an example, the human is suffering from or at risk of a Nav1.7-mediated disease or condition. In an example, the method treats or reduces the risk of a Nav1.7-mediated disease or condition in the human.

In an embodiment, (i) the antibody or fragment comprises a VH domain derived from the recombination of a human VH segment, a human D gene segment and a human JH segment, the human VH segment encoding the framework 1 of SEQ ID NO: 40 and wherein said human comprises a VH gene segment encoding the framework 1 of SEQ ID NO: 40, or the human expresses VH domains that comprise the framework 1 of SEQ ID NO: 40; and wherein (ii) said human comprises a nucleotide sequence encoding said Nav1.7 protein comprising said amino acid selected from the group consisting of 136I, 216S, 241T, 395K, 848T, 858H, 858F, 863P, 1449V, 996C, 1298F, 1298D, 1299F, 1461T, 1462V, 14641, 1627K, 277X (wherein X is an amino acid other than R), 328X (wherein X is an amino acid other than Y), 395K, 459X (wherein X is an amino acid other than S), 693 X (wherein X is an amino acid other than E), 767X (wherein X is an amino acid other than I), 830X (wherein X is an amino acid other than R), 897X (wherein X is an amino acid other than W), 1200L, 1235L, 1488X (wherein X is an amino acid other than R), 1659X (wherein X is an amino acid other than K), 1689X (wherein X is an amino acid other than W), 422D, 490N, 943L, 1002L, 1161W and 1919G.

Additionally or alternatively, in an embodiment, (i) the antibody or fragment comprises a human gamma-4 heavy chain constant region that comprises a Leu at position 189 shown in SEQ ID NO: 73 or an Arg at position 289 shown in SEQ ID NO: 73 and wherein said human comprises an IGHG4*01 human heavy chain constant region gene segment, or the human expresses antibodies comprising human gamma-4 heavy chain constant regions comprising a Leu at position 189 shown in SEQ ID NO: 73 or an Arg at position 289 shown in SEQ ID NO: 73; and wherein (ii) said human comprises a nucleotide sequence encoding said Nav1.7 protein comprising said amino acid selected from the group consisting of 136I, 216S, 241T, 395K, 848T, 858H, 858F, 863P, 1449V, 996C, 1298F, 1298D, 1299F, 1461T, 1462V, 1464I, 1627K, 277X (wherein X is an amino acid other than R), 328X (wherein X is an amino acid other than Y), 395K, 459X (wherein X is an amino acid other than S), 693 X (wherein X is an amino acid other than E), 767X (wherein X is an amino acid other than I), 830X (wherein X is an amino acid other than R), 897X (wherein X is an amino acid other than W), 1200L, 1235L, 1488X (wherein X is an amino acid other than R), 1659X (wherein X is an amino acid other than K), 1689X (wherein X is an amino acid other than W), 422D, 490N, 943L, 1002L, 1161W and 1919G.

In an example, the ligand, antibody or fragment is for treating or reducing the risk of (or treats or reduces the risk of) pain or itching, optionally wherein the antibody is a humanized mouse or Camelid (eg, llama or camel) antibody.

In a specific embodiment, the anti-Nav1.7 ligand, antibody or fragment also specifically binds to another Nav selected from Nav1.1-1.9, eg, it specifically binds to Nav1.8 or 1.9.

In a specific embodiment, the anti-Nav1.7 ligand, antibody or fragment of present invention comprises an Fc region, wherein the Fc region comprises at least one non-native amino acid residue selected from the group consisting of 234D, 234E, 234N, 234Q, 234T, 234H, 234Y, 234I, 234V, 234F, 235A, 235D, 235R, 235W, 235P, 235S, 235N, 235Q, 235T, 235H, 235Y, 235I, 235V, 235F, 236E, 239D, 239E, 239N, 239Q, 239F, 239T, 239H, 239Y, 240I, 240A, 240T, 240M, 241W, 241 L, 241Y, 241E, 241 R. 243W, 243L 243Y, 243R, 243Q, 244H, 245A, 247L, 247V, 247G, 251F, 252Y, 254T, 255L, 256E, 256M, 262I, 262A, 262T, 262E, 263I, 263A, 263T, 263M, 264L, 264I, 264W, 264T, 264R, 264F, 264M, 264Y, 264E, 265G, 265N, 265Q, 265Y, 265F, 265V, 265I, 265L, 265H, 265T, 266I, 266A, 266T, 266M, 267Q, 267L, 268E, 269H, 269Y, 269F, 269R, 270E, 280A, 284M, 292P, 292L, 296E, 296Q, 296D, 296N, 296S, 296T, 296L, 296I, 296H, 269G, 297S, 297D, 297E, 298H, 298I, 298T, 298F, 299I, 299L, 299A, 299S, 299V, 299H, 299F, 299E, 305I, 313F, 316D, 325Q, 325L, 325I, 325D, 325E, 325A, 325T, 325V, 325H, 327G, 327W, 327N, 327L, 328S, 328M, 328D, 328E, 328N, 328Q, 328F, 328I, 328V, 328T, 328H, 328A, 329F, 329H, 329Q, 330K, 330G, 330T, 330C, 330L, 330Y, 330V, 330I, 330F, 330R, 330H, 331G, 331A, 331L, 331M, 331F, 331W, 331K, 331Q, 331E, 331S, 331V, 331I, 331C, 331Y, 331H, 331R, 331N, 331D, 331T, 332D, 332S, 332W, 332F, 332E, 332N, 332Q, 332T, 332H, 332Y, 332A, 339T, 370E, 370N, 378D, 392T, 396L, 416G, 419H, 421K, 440Y and 434W as numbered by the EU index as set forth in Kabat. Optionally, the Fc region may comprise additional and/or alternative non-native amino acid residues known to one skilled in the art (see, e.g., U.S. Pat. Nos. 5,624,821; 6,277,375; 6,737,056; PCT Patent Publications WO 01/58957; WO 02/06919; WO 04/016750; WO 04/029207; WO 04/035752 and WO 05/040217).

The ligand, antibody or fragment according to the invention is for treating or preventing or reducing the risk of (or treats or prevents or reduces the risk of), for example, any disease or condition disclosed in WO2011/051351, the disclosure of which diseases and conditions are incorporated herein by reference for potential inclusion in one or more claims herein. Guidance on obtaining and testing antibodies can also be found in that PCT application.

Further encompassed by the invention is the use of the ligand, antibody or fragment in the manufacture of a medicament for use to attenuate or inhibit a Nav1.7-mediated disease or disorder in a human. Nav1.7-mediated or related disorders which are treated by the ligand, antibody or fragment of the invention include, for example, a pain or itching disease or condition.

Thus, a ligand, antibody or fragment of the invention is useful as a therapeutic agent in the treatment of a condition involving Nav1.7 expression and/or activity. One embodiment, among others, is a method of treatment comprising administering an effective amount of a ligand, antibody or fragment of the invention to a patient in need thereof, wherein functional consequences of Nav1.7 activation are decreased. Another embodiment, among others, is a method of treatment comprising (i) identifying a patient demonstrating Nav1.7 expression or activity, and (ii) administering an effective amount of a ligand, antibody or fragment of the invention to the patient, wherein a functional consequence of Nav1.7 activation are attenuated. An effective amount according to the invention is an amount that modulates (e.g. decreases) the functional consequences of Nav1.7 activation so as to modulate (e.g. decrease or lessen) the severity of at least one symptom of the particular disease or disorder being treated, but not necessarily cure the disease or disorder. Accordingly, one embodiment of the invention is a method of treating or reducing the severity of at least one symptom of any of the disorders referred to herein, comprising administering to a patient in need thereof an effective amount of one or more ligands, antibodies or fragments of the present invention alone or in a combined therapeutic regimen with another appropriate medicament known in the art or described herein such that the severity of at least one symptom of any of the disorders is reduced. Another embodiment of the invention, among others, is a method of antagonizing at least one effect of Nav1.7 comprising contacting with or administering an effective amount of one or more ligands, antibodies or fragments of the present invention such that said at least one effect of Nav1.7 is antagonized, e.g. the ability of Nav1.7 to form an ion channel, such as a sodium channel.

Tailoring Antibodies to Rarer Nav1.7 Variant Profile

As outlined herein (for example, in the context of PCSK9 in Example 1), the invention includes the possibility to tailor treatment of humans further by selecting antibody-based ligands with variable domains and/or constant domains based on gene segments found in many humans of the ethnic populations where the variant TOI forms are found to meet the selection criteria of the invention. This also applies mutatis mutandis where the TOI is huma Nav1.7, as in the present example. Thus, all disclosure herein relating to tailoring variable and/or constant domains apply to the present example, relating to Nav1.7 and is combinable for use in one or more claims herein.

As described in Example 1, an example is provided for ligands comprising antibody VH domains derived from recombination of human IGHV gene segments comprising selected nucleotides at positions in the HCDR1 or FW3 where there is variability in humans (ie, where SNPs occur in humans).

Further information is provided in Table 4, which shows variation at these positions, as well as the variant distributions across the 1000 Genomes Project database relating to many human populations.

In other embodiments, as explained more fully above, the invention provides for ligands which are tailored to the human recipient's genotype and/or phenotype based on alternative human VH gene segments, or on Vκ, Vλ or constant region gene segments (see further Table 9 for representative variants).

Further examples, therefore are:—

(i) wherein the ligand comprises a VH domain derived from the recombination of a human VH segment (eg, human VH3-23*04), a human D gene segment and a human JH segment, the human VH segment encoding the framework 1 of SEQ ID NO: 40 and wherein said human comprises a VH gene segment encoding the framework 1 of SEQ ID NO: 40, or the human expresses VH domains that comprise the framework 1 of SEQ ID NO: 40.

(ii) wherein the ligand comprises a VH domain derived from the recombination of human VH segment IGHV3-7*01, a human D gene segment and a human JH segment, and wherein said human comprises a IGHV3-7*01 VH gene segment or the human expresses VH domains derived from the recombination of human VH segment IGHV3-7*01, a human D gene segment and a human JR segment.

(iii) wherein the ligand comprises a Vκ domain derived from the recombination of human Vκ segment IGKV1-12*01 and a human Jκ segment, and wherein said human comprises a IGKV1-12*01 Vκ gene segment or the human expresses Vκ domains derived from the recombination of human Vκ segment IGKV1-12*01 and a human Jκ segment.

(iv) wherein the ligand comprises a Vκ domain derived from the recombination of a human Vκ segment and a human Jκ segment, the human Vκ segment encoding (i) a CDR3 comprising a Pro at position 7 shown in SEQ ID NO: 36 and wherein said human comprises a Vκ gene segment encoding a CDR3 comprising a Pro at position 7 shown in SEQ ID NO: 36, or the human expresses Vκ domains that comprise a CDR3 comprising a Pro at position 7 shown in SEQ ID NO: 36; or (ii) a FW3 comprising a Ser at position 15 shown in SEQ ID NO: 38 and wherein said human comprises a Vκ gene segment encoding a FW3 comprising a Ser at position 15 shown in SEQ ID NO: 38 or the human expresses Vκ domains that comprise a FW3 comprising a Ser at position 15 shown in SEQ ID NO: 38.

(v) wherein the ligand comprises a human gamma-1 heavy chain constant region that comprises an Asp at position 204 shown in SEQ ID NO: 4 or a Leu at position 206 shown in SEQ ID NO: 4 and wherein said human comprises (i) an IGHG1*01 human heavy chain constant region gene segment, or the human expresses antibodies comprising human gamma-1 heavy chain constant regions comprising an Asp at position 204 shown in SEQ ID NO: 4 or a Leu at position 206 shown in SEQ ID NO: 4.

(vi) wherein the ligand comprises a human gamma-2 heavy chain constant region that comprises an amino acid selected from the group consisting of a Pro at position 72 shown in SEQ ID NO: 6, an Asn at position 75 shown in SEQ ID NO: 6, a Phe at position 76 shown in SEQ ID NO: 6, a Val at position 161 shown in SEQ ID NO: 6 and an Ala at position 257 shown in SEQ ID NO: 6 and wherein said human comprises (i) an IGHG2*01 human heavy chain constant region gene segment, or the human expresses antibodies comprising human gamma-2 heavy chain constant regions comprising said selected Pro at position 72 shown in SEQ ID NO: 6, Asn at position 75 shown in SEQ ID NO: 6, Phe at position 76 shown in SEQ ID NO: 6, Val at position 161 shown in SEQ ID NO: 6 or Ala at position 257 shown in SEQ ID NO: 6.

(vii) wherein the ligand comprises a human kappa chain constant region that comprises a Val at position 84 shown in SEQ ID NO: 16 or a Cys at position 87 shown in SEQ ID NO: 16 and wherein said human comprises (i) an IGKC1*01 human kappa chain constant region gene segment, or the human expresses antibodies comprising human kappa chain constant regions comprising a Val corresponding to position 84 shown in SEQ ID NO: 16 or a Cys at position 87 shown in SEQ ID NO: 16.

(viii) wherein the ligand comprises a human IGLC1*01 lambda chain constant region and wherein said human comprises (i) a human IGLC1*01 lambda chain constant region gene segment, or the human expresses antibodies comprising human IGLC1*01 lambda chain constant regions.

(ix) wherein the ligand comprises a human gamma-4 heavy chain constant region that comprises a Leu at position 189 shown in SEQ ID NO: 73 or an Arg at position 289 shown in SEQ ID NO: 73 and wherein said human comprises (i) an IGHG4*01 human heavy chain constant region gene segment, or the human expresses antibodies comprising human gamma-4 heavy chain constant regions comprising a Leu at position 189 shown in SEQ ID NO: 73 or an Arg at position 289 shown in SEQ ID NO: 73.

(x) wherein the ligand comprises a human gamma-3 heavy chain constant region encoded by a first human IGHG3 (eg, IGHG3*01) constant region gene segment and wherein said human comprises (i) said first constant region gene segment (eg, an IGHG3*01), or the human expresses antibodies comprising human gamma-3 heavy chain constant regions encoded by said first human IGHG3 (eg, IGHG3*01) constant region gene segment.

(xi) wherein the ligand comprises a human epsilon heavy chain constant region encoded by a first human epsilon heavy chain constant region gene segment and wherein said human comprises (i) said first constant region gene segment, or the human expresses antibodies comprising human epsilon heavy chain constant regions encoded by said first constant region gene segment.

(xii) wherein the ligand comprises a human mu heavy chain constant region encoded by a first human mu heavy chain constant region gene segment and wherein said human comprises (i) said first constant region gene segment, or the human expresses antibodies comprising human mu heavy chain constant regions encoded by said first constant region gene segment.

(xiii) wherein the ligand comprises a human alpha heavy chain constant region encoded by a first human alpha heavy chain constant region gene segment and wherein said human comprises (i) said first constant region gene segment, or the human expresses antibodies comprising human alpha heavy chain constant regions encoded by said first constant region gene segment.

(xiv) wherein the ligand comprises a human delta heavy chain constant region encoded by a first human delta heavy chain constant region gene segment and wherein said human comprises (i) said first constant region gene segment, or the human expresses antibodies comprising human delta heavy chain constant regions encoded by said first constant region gene segment.

(xv) wherein the ligand comprises a human kappa light chain constant region encoded by a first human kappa light chain constant region gene segment and wherein said human comprises (i) said first constant region gene segment, or the human expresses antibodies comprising human kappa light chain constant regions encoded by said first constant region gene segment.

(xvi) wherein the ligand comprises a human lambda light chain constant region encoded by a first human lambda light chain constant region gene segment and wherein said human comprises (i) said first constant region gene segment, or the human expresses antibodies comprising human lambda light chain constant regions encoded by said first constant region gene segment.

These examples, although written in the context of the present Nav1.7 example, are applicable to the invention as it relates to any other TOI herein and thus can be combined and used in claims herein relating to any TOI. In any of these example, the ligand is optionally an antibody, eg, a human or humanised antibody (eg, a humanised mouse, rat or Camelid antibody).

For ADCC efficacy for human constant regions is:
    IgG1≥IgG3>>IgG4≥IgG2

For CDC efficacy for human constant regions is:
    IgG3≥IgG1>>IgG2≈IgG4

Thus, it may be advantageous for Nav1.7 ligands, for the ligand to comprise a gamma-4 or gamma-2 constant region (eg, as per the examples above). For example, the gamma-4 is an IgG4PE (ie, a gamma-4 constant region with 228Pro and 235Glu). For example the gamma-2 is an IgG2Δa.

For example, as per example (ix), the inventor identified the possibility of addressing IGH-gamma-4 variation and identified utility for variations 189L and 289R individually or in combination, since these residues are part of the CH3 domain, and as such they form part of antibody Fc regions. Thus, matching of these CH3 variations with the patient is especially beneficial for reasons as discussed above. Thus, in this example the ligand of the invention comprises or consists of an antibody that comprises a human gamma-4 heavy chain constant region that comprises a Leu corresponding to position 189 of SEQ ID NO: 73 or an Arg corresponding to position 289 of SEQ ID NO: 73 and wherein the genome of the human comprises a gamma-4 heavy chain constant region nucleotide sequence that encodes such a Leu and/or Arg or the human expresses antibodies comprising human gamma-4 constant regions comprising such a Leu and/or Arg.

Determination of Specific Binding of Ligands of the Invention to NAV1.7 Variants The specific binding of ligands of the invention to Nav1.7 variants can be performed using the SPR method described in Example 1.

Embodiments are provided as follows:—
Methods with VH Tailoring

1. A method of treating or reducing the risk of a Nav1.7-mediated disease or condition in a human in need thereof, the method comprising administering to said human a ligand (eg, an antibody or antibody fragment) that specifically binds a huma Nav1.7 protein that comprises an amino acid selected from the group consisting of 136I, 216S, 241T, 395K, 848T, 858H, 858F, 863P, 1449V, 996C, 1298F, 1298D, 1299F, 1461T, 1462V, 1464I, 1627K, 277X (wherein X is an amino acid other than R), 328X (wherein X is an amino acid other than Y), 395K, 459X (wherein X is an amino acid other than S), 693 X (wherein X is an amino acid other than E), 767X (wherein X is an amino acid other than I), 830X (wherein X is an amino acid other than R), 897X (wherein X is an amino acid other than W), 1200L, 1235L, 1488X (wherein X is an amino acid other than R), 1659X (wherein X is an amino acid other than K), 1689X (wherein X is an amino acid other than W), 422D, 490N, 943L, 1002L, 1161W and 1919G;
wherein (i) the ligand comprises a VH domain derived from the recombination of a human VH segment, a human D gene segment and a human JH segment, the human VH segment encoding the framework 1 of SEQ ID NO: 40 and wherein said human comprises a VH gene segment encoding the framework 1 of SEQ ID NO: 40, or the human expresses VH domains that comprise the framework 1 of SEQ ID NO: 40; and
wherein (ii) said human comprises a nucleotide sequence encoding said Nav1.7 protein comprising said amino acid selected from the group consisting of 136I, 216S, 241T, 395K, 848T, 858H, 858F, 863P, 1449V, 996C, 1298F, 1298D, 1299F, 1461T, 1462V, 1464I, 1627K, 277X (wherein X is an amino acid other than R), 328X (wherein X is an amino acid other than Y), 395K, 459X (wherein X is an amino acid other than S), 693 X (wherein X is an amino acid other than E), 767X (wherein X is an amino acid other than I), 830X (wherein X is an amino acid other than R), 897X (wherein X is an amino acid other than W), 1200L, 1235L, 1488X (wherein X is an amino acid other than R), 1659X (wherein X is an amino acid other than K), 1689X (wherein X is an amino acid other than W), 422D, 490N, 943L, 1002L, 1161W and 1919G.

In an alternative, clause 1 provides:—

A method of targeting Nav1.7 in a human, the method comprising administering to said human a ligand (eg, an antibody or antibody fragment) that specifically binds a huma Nav1.7 protein that comprises an amino acid selected from the group consisting of 136I, 216S, 241T, 395K, 848T, 858H, 858F, 863P, 1449V, 996C, 1298F, 1298D, 1299F, 1461T, 1462V, 1464I, 1627K, 277X (wherein X is an amino acid other than R), 328X (wherein X is an amino acid other than Y), 395K, 459X (wherein X is an amino acid other than S), 693 X (wherein X is an amino acid other than E), 767X (wherein X is an amino acid other than I), 830X (wherein X is an amino acid other than R), 897X (wherein X is an amino acid other than W), 1200L, 1235L, 1488X (wherein X is an amino acid other than R), 1659X (wherein X is an amino acid other than K), 1689X (wherein X is an amino acid other than W), 422D, 490N, 943L, 1002L, 1161W and 1919G;
wherein (i) the ligand comprises a VH domain derived from the recombination of a human VH segment, a human D gene segment and a human JH segment, the human VH segment encoding the framework 1 of SEQ ID NO: 40 and wherein said human comprises a VH gene segment encoding the framework 1 of SEQ ID NO: 40, or the human expresses VH domains that comprise the framework 1 of SEQ ID NO: 40; and
wherein (ii) said human comprises a nucleotide sequence encoding said Nav1.7 protein comprising said amino acid selected from the group consisting of 136I, 216S, 241T, 395K, 848T, 858H, 858F, 863P, 1449V, 996C, 1298F, 1298D, 1299F, 1461T, 1462V, 1464I, 1627K, 277X (wherein X is an amino acid other than R), 328X (wherein X is an amino acid other than Y), 395K, 459X (wherein X is an amino acid other than S), 693 X (wherein X is an amino acid other than E), 767X (wherein X is an amino acid other than I), 830X (wherein X is an amino acid other than R), 897X (wherein X is an amino acid other than W), 1200L, 1235L, 1488X (wherein X is an amino acid other than R), 1659X (wherein X is an amino acid other than K), 1689X (wherein X is an amino acid other than W), 422D, 490N, 943L, 1002L, 1161W and 1919G.

In an example, the human is suffering from or at risk of a Nav1.7-mediated disease or condition.

In an example, the method treats or reduces the risk of a Nav1.7-mediated disease or condition in the human.

2. The method of any preceding clause, wherein said amino acid is selected from the group consisting of any one of 136I, 216S, 241T, 395K, 848T, 858H, 858F, 863P and 1449V; optionally wherein said disease or condition is a pain disease or condition.

3. The method of any preceding clause, wherein said amino acid is selected from the group consisting of 996C, 1298F, 1298D, 1299F, 1461T, 1462V, 1464I and 1627K; optionally wherein said disease or condition is a pain disease or condition.

4. The method of any preceding clause, wherein said amino acid is selected from the group consisting of 277X (wherein X is an amino acid other than R), 328X (wherein X is an amino acid other than Y), 395K, 459X (wherein X is an amino acid other than S), 693 X (wherein X is an amino acid other than E), 767X (wherein X is an amino acid other than I), 830X (wherein X is an amino acid other than R), 897X (wherein X is an amino acid other than W), 1200L, 1235L, 1488X (wherein X is an amino acid other than R), 1659X (wherein X is an amino acid other than K) and 1689X (wherein X is an amino acid other than W); optionally wherein said disease or condition is a pain disease or condition.

5. The method of any preceding clause, wherein the VH gene segment comprised by said human is a germline VH gene segment.

6. The method of any preceding clause comprising, before said administering, selecting a human comprising said nucleotide sequence of (ii), wherein the human is the human of clause 1.

7. The method of any preceding clause, wherein the human has been determined to comprise the nucleotide sequence that encodes a Nav1.7 protein comprising said amino acid selected from the group consisting of 136I, 216S, 241T, 395K, 848T, 858H, 858F, 863P, 1449V, 996C, 1298F, 1298D, 1299F, 1461T, 1462V, 1464I, 1627K, 277X (wherein X is an amino acid other than R), 328X (wherein X is an amino acid other than Y), 395K, 459X (wherein X is an amino acid other than S), 693 X (wherein X is an amino acid other than E), 767X (wherein X is an amino acid other than I), 830X (wherein X is an amino acid other than R), 897X (wherein X is an amino acid other than W), 1200L, 1235L, 1488X (wherein X is an amino acid other than R), 1659X (wherein X is an amino acid other than K), 1689X (wherein X is an amino acid other than W), 422D, 490N, 943L, 1002L, 1161W and 1919G and/or a Nav1.7 protein comprising said amino acid selected from the group consisting of 136I, 216S, 241T, 395K, 848T, 858H, 858F, 863P, 1449V, 996C, 1298F, 1298D, 1299F, 1461T, 1462V, 1464I, 1627K, 277X (wherein X is an amino acid other than R), 328X (wherein X is an amino acid other than Y), 395K, 459X (wherein X is an amino acid other than S), 693 X (wherein X is an amino acid other than E), 767X (wherein X is an amino acid other than I), 830X (wherein X is an amino acid other than R), 897X (wherein X is an amino acid other than W), 1200L, 1235L, 1488X (wherein X is an amino acid other than R), 1659X (wherein X is an amino acid other than K), 1689X (wherein X is an amino acid other than W), 422D, 490N, 943L, 1002L, 1161W and 1919G.

8. The method of any preceding clause, comprising the step of determining that the human comprises (a) the nucleotide sequence that encodes a Nav1.7 protein comprising said amino acid selected from the group consisting of 136I, 216S, 241T, 395K, 848T, 858H, 858F, 863P, 1449V, 996C, 1298F, 1298D, 1299F, 1461T, 1462V, 1464I, 1627K, 277X (wherein X is an amino acid other than R), 328X (wherein X is an amino acid other than Y), 395K, 459X (wherein X is an amino acid other than S), 693 X (wherein X is an amino acid other than E), 767X (wherein X is an amino acid other than I), 830X (wherein X is an amino acid other than R), 897X (wherein X is an amino acid other than W), 1200L, 1235L, 1488X (wherein X is an amino acid other than R), 1659X (wherein X is an amino acid other than K), 1689X (wherein X is an amino acid other than W), 422D, 490N, 943L, 1002L, 1161W and 1919G and/or (b) a Nav1.7 protein comprising said amino acid selected from the group consisting of 136I, 216S, 241T, 395K, 848T, 858H, 858F, 863P, 1449V, 996C, 1298F, 1298D, 1299F, 1461T, 1462V, 1464I, 1627K, 277X (wherein X is an amino acid other than R), 328X (wherein X is an amino acid other than Y), 395K, 459X (wherein X is an amino acid other than S), 693 X (wherein X is an amino acid other than E), 767X (wherein X is an amino acid other than I), 830X (wherein X is an amino acid other than R), 897X (wherein X is an amino acid other than W), 1200L, 1235L, 1488X (wherein X is an amino acid other than R), 1659X (wherein X is an amino acid other than K), 1689X (wherein X is an amino acid other than W), 422D, 490N, 943L, 1002L, 1161W and 1919G, optionally, wherein the determining step is performed before administration of the antibody to the human.

9. The method of clause 8, wherein the step of determining comprises assaying a biological sample from the human for a nucleotide sequence encoding a Nav1.7 protein comprising said amino acid selected from the group consisting of 136I, 216S, 241T, 395K, 848T, 858H, 858F, 863P, 1449V, 996C, 1298F, 1298D, 1299F, 1461T, 1462V, 1464I, 1627K, 277X (wherein X is an amino acid other than R), 328X (wherein X is an amino acid other than Y), 395K, 459X (wherein X is an amino acid other than S), 693 X (wherein X is an amino acid other than E), 767X (wherein X is an amino acid other than I), 830X (wherein X is an amino acid other than R), 897X (wherein X is an amino acid other than W), 1200L, 1235L, 1488X (wherein X is an amino acid other than R), 1659X (wherein X is an amino acid other than K), 1689X (wherein X is an amino acid other than W), 422D, 490N, 943L, 1002L, 1161W and 1919G.

10. The method of clause 9, wherein the assaying comprises contacting the biological sample with at least one oligonucleotide probe comprising a sequence of at least 10 contiguous nucleotides of a nucleotide sequence encoding a Nav1.7 protein comprising said amino acid selected from the group consisting of 136I, 216S, 241T, 395K, 848T, 858H, 858F, 863P, 1449V, 996C, 1298F, 1298D, 1299F, 1461T, 1462V, 1464I, 1627K, 277X (wherein X is an amino acid other than R), 328X (wherein X is an amino acid other than Y), 395K, 459X (wherein X is an amino acid other than S), 693 X (wherein X is an amino acid other than E), 767X (wherein X is an amino acid other than I), 830X (wherein X is an amino acid other than R), 897X (wherein X is an amino acid other than W), 1200L, 1235L, 1488X (wherein X is an amino acid other than R), 1659X (wherein X is an amino acid other than K), 1689X (wherein X is an amino acid other than W), 422D, 490N, 943L, 1002L, 1161W and 1919G or comprising an antisense sequence of said contiguous nucleotides, wherein said sequence of contiguous nucleotides comprises a nucleotide sequence encoding said amino acid selected from the group consisting of 136I, 216S, 241T, 395K, 848T, 858H, 858F, 863P, 1449V, 996C, 1298F, 1298D, 1299F, 1461T, 1462V, 1464I, 1627K, 277X (wherein X is an amino acid other than R), 328X (wherein X is an amino acid other than Y), 395K, 459X (wherein X is an amino acid other than S), 693 X (wherein X is an amino acid other than E), 767X (wherein X is an amino acid other than I), 830X (wherein X is an amino acid other than R), 897X (wherein X is an amino acid other than W), 1200L, 1235L, 1488X (wherein X is an amino acid other than R), 1659X (wherein X is an amino acid other than K), 1689X (wherein X is an amino acid other than W), 422D, 490N, 943L, 1002L, 1161W and 1919G, thereby forming a complex when at least one nucleotide sequence encoding the Nav1.7 protein comprising said amino acid selected from the group consisting of 136I, 216S, 241T, 395K, 848T, 858H, 858F, 863P, 1449V, 996C, 1298F, 1298D, 1299F, 1461T, 1462V, 14641, 1627K, 277X (wherein X is an amino acid other than R), 328X (wherein X is an amino acid other than Y), 395K, 459X (wherein X is an amino acid other than S), 693 X (wherein X is an amino acid other than E), 767X (wherein X is an amino acid other than I), 830X (wherein X is an amino acid other than R), 897X (wherein X is an amino acid other than W), 1200L, 1235L, 1488X (wherein X is an amino acid other than R), 1659X (wherein X is an amino acid other than K), 1689X (wherein X is an amino acid other than W), 422D, 490N, 943L, 1002L, 1161W and 1919G is present; and detecting the presence or absence of the complex, wherein detecting the presence of the complex determines that the human comprises the Nav1.7 protein comprising said amino acid selected from the group consisting of 136I, 216S, 241T, 395K, 848T, 858H, 858F, 863P, 1449V, 996C, 1298F, 1298D, 1299F, 1461T, 1462V, 14641, 1627K, 277X (wherein X is an amino acid other than R), 328X (wherein X is an amino acid other than Y), 395K, 459X (wherein X is an amino acid other than S), 693 X (wherein X is an amino acid other than E), 767X (wherein X is an amino acid other than I), 830X (wherein X is an amino acid other than R), 897X (wherein X is an amino acid other than W), 1200L, 1235L, 1488X (wherein X is an amino acid other than R), 1659X (wherein X is an amino acid other than K), 1689X (wherein X is an amino acid other than W), 422D, 490N, 943L, 1002L, 1161W and 1919G.

11. The method of clause 9, wherein the assaying comprises nucleic acid amplification and optionally one or more methods selected from sequencing, next generation sequencing, nucleic acid hybridization, and allele-specific amplification and/or wherein the assaying is performed in a multiplex format.
12. The method of clause 9 or 11, wherein said biological sample comprises serum, blood, feces, tissue, a cell, urine and/or saliva of said human.
13. The method of any preceding clause, wherein said human is indicated as heterozygous for a nucleotide sequence encoding the Nav1.7 protein comprising said amino acid selected from the group consisting of 136I, 216S, 241T, 395K, 848T, 858H, 858F, 863P, 1449V, 996C, 1298F, 1298D, 1299F, 1461T, 1462V, 14641, 1627K, 277X (wherein X is an amino acid other than R), 328X (wherein X is an amino acid other than Y), 395K, 459X (wherein X is an amino acid other than S), 693 X (wherein X is an amino acid other than E), 767X (wherein X is an amino acid other than I), 830X (wherein X is an amino acid other than R), 897X (wherein X is an amino acid other than W), 1200L, 1235L, 1488X (wherein X is an amino acid other than R), 1659X (wherein X is an amino acid other than K), 1689X (wherein X is an amino acid other than W), 422D, 490N, 943L, 1002L, 1161W and 1919G, optionally, wherein said human is further indicated as comprising the nucleotide sequence of SEQ ID NO: 76, or said human is indicated as homozygous for a nucleotide sequence encoding the Nav1.7 protein comprising said amino acid selected from the group consisting of 136I, 216S, 241T, 395K, 848T, 858H, 858F, 863P, 1449V, 996C, 1298F, 1298D, 1299F, 1461T, 1462V, 14641, 1627K, 277X (wherein X is an amino acid other than R), 328X (wherein X is an amino acid other than Y), 395K, 459X (wherein X is an amino acid other than S), 693 X (wherein X is an amino acid other than E), 767X (wherein X is an amino acid other than I), 830X (wherein X is an amino acid other than R), 897X (wherein X is an amino acid other than W), 1200L, 1235L, 1488X (wherein X is an amino acid other than R), 1659X (wherein X is an amino acid other than K), 1689X (wherein X is an amino acid other than W), 422D, 490N, 943L, 1002L, 1161W and 1919G.
14. The method of any preceding clause, wherein said human is or has been further determined to be substantially resistant to a pain or itching treatment.
15. The method of any preceding clause, wherein said human is receiving or has received a pain or itching treatment or has reduced responsiveness to a pain or itching treatment.
16. The method of any preceding clause, wherein said disease or condition is a pain or itching disease or condition.
17. The method of any preceding clause, wherein said disease or condition is a channelopathy or associated with a channelopathy; or is selected from the group consisting of primary erythermalgia (PE), paroxysmal extreme pain disorder (PEPD) and channelopathy-associated insensitivity to pain (CIP).
18. The method of any preceding clause, wherein said human has been diagnosed with at least one condition recited in clause 16 or 17.
19. The method of any preceding clause, wherein said antibody or antibody fragment treats or reduces the risk in said human of a condition recited in clause 16 or 17.
20. The method of any preceding clause, wherein the nucleotide sequence comprises one or more SNPs selected from the group consisting of rs6746030, rs3750904, rs58022607, rs4369876, rs13402180 and rs12478318.
21. The method of any preceding clause, wherein said ligand (eg, antibody or antibody fragment) is administered by inhaled, intravenous or subcutaneous administration and/or is comprised in an inhalable or injectable preparation.

Preferably herein the Nav1.7 mutation is 1161W (also known as 1150W in some publications, eg, Reimann et al (Proc Natl Acad Sci USA. 2010 Mar. 16; 107(11):5148-53. doi: 10.1073/pnas.0913181107. Epub 2010 Mar. 8; "Pain perception is altered by a nucleotide polymorphism in SCN9A"; Reimann F et al). This describes the correlation of 1150W (ie, 1161W) with increased pain perception (lower threshold) in normal humans.

Ligands with VH Tailoring

1. A ligand (eg, an antibody or antibody fragment) for use in a method of treating or reducing the risk of a Nav1.7-mediated disease or condition (eg, asthma) in a human in need thereof, wherein the ligand specifically binds a human Nav1.7 protein that comprises an amino acid selected from the group consisting of 136I, 216S, 241T, 395K, 848T, 858H, 858F, 863P, 1449V, 996C, 1298F, 1298D, 1299F, 1461T, 1462V, 14641, 1627K, 277X (wherein X is an amino acid other than R), 328X (wherein X is an amino acid other than Y), 395K, 459X (wherein X is an amino acid other than S), 693 X (wherein X is an amino acid other than E), 767X (wherein X is an amino acid other than I), 830X (wherein X is an amino acid other than R), 897X (wherein X is an amino acid other than W), 1200L, 1235L, 1488X (wherein X is an amino acid other than R), 1659X (wherein X is an amino acid other than K), 1689X (wherein X is an amino acid other than W), 422D, 490N, 943L, 1002L, 1161W and 1919G;
  wherein (i) the ligand comprises a VH domain derived from the recombination of a human VH segment, a human D gene segment and a human JH segment, the human VH segment encoding the framework 1 of SEQ ID NO: 40 and wherein said human comprises a VH gene segment encoding the framework 1 of SEQ ID NO: 40, or the human expresses VH domains that comprise the framework 1 of SEQ ID NO: 40; and
  wherein (ii) said human comprises a nucleotide sequence encoding said Nav1.7 protein comprising said amino acid selected from the group consisting of 136I, 216S, 241T, 395K, 848T, 858H, 858F, 863P, 1449V, 996C, 1298F, 1298D, 1299F, 1461T, 1462V, 1464I, 1627K, 277X (wherein X is an amino acid other than R), 328X (wherein X is an amino acid other than Y), 395K, 459X (wherein X is an amino acid other than S), 693 X (wherein X is an amino acid other than E), 767X (wherein X is an amino acid other than I), 830X (wherein X is an amino acid other than R), 897X (wherein X is an amino acid other than W), 1200L, 1235L, 1488X (wherein X is an amino acid other than R), 1659X (wherein X is an amino acid other than K), 1689X (wherein X is an amino acid other than W), 422D, 490N, 943L, 1002L, 1161W and 1919G.

In an alternative, paragraph 1 provides:—

A ligand (eg, an antibody or antibody fragment) for use in a method of targeting Nav1.7 in a human, wherein the ligand specifically binds a huma Nav1.7 protein that comprises an amino acid selected from the group consisting of 136I, 216S, 241T, 395K, 848T, 858H, 858F, 863P, 1449V, 996C, 1298F, 1298D, 1299F, 1461T, 1462V, 1464I, 1627K, 277X (wherein X is an amino acid other than R), 328X (wherein X is an amino acid other than Y), 395K, 459X (wherein X is an amino acid other than S), 693 X (wherein X is an amino acid other than E), 767X (wherein X is an amino acid other than I), 830X (wherein X is an amino acid other than R), 897X (wherein X is an amino acid other than W), 1200L, 1235L, 1488X (wherein X is an amino acid other than R), 1659X (wherein X is an amino acid other than K), 1689X (wherein X is an amino acid other than W), 422D, 490N, 943L, 1002L, 1161W and 1919G;
  wherein (i) the ligand comprises a VH domain derived from the recombination of a human VH segment, a human D gene segment and a human JH segment, the human VH segment encoding the framework 1 of SEQ ID NO: 40 and wherein said human comprises a VH gene segment encoding the framework 1 of SEQ ID NO: 40, or the human expresses VH domains that comprise the framework 1 of SEQ ID NO: 40; and
  wherein (ii) said human comprises a nucleotide sequence encoding said Nav1.7 protein comprising said amino acid selected from the group consisting of 136I, 216S, 241T, 395K, 848T, 858H, 858F, 863P, 1449V, 996C, 1298F, 1298D, 1299F, 1461T, 1462V, 1464I, 1627K, 277X (wherein X is an amino acid other than R), 328X (wherein X is an amino acid other than Y), 395K, 459X (wherein X is an amino acid other than S), 693 X (wherein X is an amino acid other than E), 767X (wherein X is an amino acid other than I), 830X (wherein X is an amino acid other than R), 897X (wherein X is an amino acid other than W), 1200L, 1235L, 1488X (wherein X is an amino acid other than R), 1659X (wherein X is an amino acid other than K), 1689X (wherein X is an amino acid other than W), 422D, 490N, 943L, 1002L, 1161W and 1919G.

In an example, the human is suffering from or at risk of a Nav1.7-mediated disease or condition.

In an example, the method treats or reduces the risk of a Nav1.7-mediated disease or condition in the human.

2. The ligand of any preceding clause, wherein said amino acid is selected from the group consisting of any one of 136I, 216S, 241T, 395K, 848T, 858H, 858F, 863P and 1449V; optionally wherein said disease or condition is a pain disease or condition.

3. The ligand of any preceding clause, wherein said amino acid is selected from the group consisting of 996C, 1298F, 1298D, 1299F, 1461T, 1462V, 1464I and 1627K; optionally wherein said disease or condition is a pain disease or condition.

4. The ligand of any preceding clause, wherein said amino acid is selected from the group consisting of 277X (wherein X is an amino acid other than R), 328X (wherein X is an amino acid other than Y), 395K, 459X (wherein X is an amino acid other than S), 693 X (wherein X is an amino acid other than E), 767X (wherein X is an amino acid other than I), 830X (wherein X is an amino acid other than R), 897X (wherein X is an amino acid other than W), 1200L, 1235L, 1488X (wherein X is an amino acid other than R), 1659X (wherein X is an amino acid other than K) and 1689X (wherein X is an amino acid other than W); optionally wherein said disease or condition is a pain disease or condition.

5. The ligand of any preceding clause, wherein the VH gene segment comprised by said human is a germline VH gene segment.

6. The ligand of any preceding clause said method comprising, before said administering, selecting a human comprising said nucleotide sequence of (ii), wherein the human is the human of clause 1.

7. The ligand of any preceding clause, wherein the human has been determined to comprise the nucleotide sequence that encodes a Nav1.7 protein comprising said amino acid selected from the group consisting of 136I, 216S, 241T, 395K, 848T, 858H, 858F, 863P, 1449V, 996C, 1298F, 1298D, 1299F, 1461T, 1462V, 1464I, 1627K, 277X (wherein X is an amino acid other than R), 328X (wherein X is an amino acid other than Y), 395K, 459X (wherein X is an amino acid other than S), 693 X (wherein X is an amino acid other than E), 767X (wherein X is an amino acid other than I), 830X (wherein X is an amino acid other than R), 897X (wherein X is an amino acid other than W), 1200L, 1235L, 1488X (wherein X is an amino acid other than R), 1659X (wherein X is an amino acid other than K), 1689X (wherein X is an amino acid other than W), 422D, 490N, 943L, 1002L, 1161W and 1919G and/or a Nav1.7 protein comprising said amino acid selected from the group consisting of 136I, 216S, 241T, 395K, 848T, 858H, 858F, 863P, 1449V, 996C, 1298F, 1298D, 1299F, 1461T, 1462V, 1464I, 1627K, 277X (wherein X is an amino acid other than R), 328X (wherein X is an amino acid other than Y), 395K, 459X (wherein X is an amino acid other than S), 693 X (wherein X is an amino acid other than E), 767X (wherein X is an amino acid other than I), 830X (wherein X is an amino acid other than R), 897X (wherein X is an amino acid other than W), 1200L, 1235L, 1488X (wherein X is an amino acid other than R), 1659X (wherein X is an amino acid other than K), 1689X (wherein X is an amino acid other than W), 422D, 490N, 943L, 1002L, 1161W and 1919G.

8. The ligand of any preceding clause, said method comprising the step of determining that the human comprises (a) the nucleotide sequence that encodes a Nav1.7 protein comprising said amino acid selected from the group consisting of 136I, 216S, 241T, 395K, 848T, 858H, 858F, 863P, 1449V, 996C, 1298F, 1298D, 1299F, 1461T, 1462V, 14641, 1627K, 277X (wherein X is an amino acid other than R), 328X (wherein X is an amino acid other than Y), 395K, 459X (wherein X is an amino acid other than S), 693 X (wherein X is an amino acid other than E), 767X (wherein X is an amino acid other than I), 830X (wherein X is an amino acid other than R), 897X (wherein X is an amino acid other than W), 1200L, 1235L, 1488X (wherein X is an amino acid other than R), 1659X (wherein X is an amino acid other than K), 1689X (wherein X is an amino acid other than W), 422D, 490N, 943L, 1002L, 1161W and 1919G and/or (b) a Nav1.7 protein comprising said amino acid selected from the group consisting of 136I, 216S, 241T, 395K, 848T, 858H, 858F, 863P, 1449V, 996C, 1298F, 1298D, 1299F, 1461T, 1462V, 14641, 1627K, 277X (wherein X is an amino acid other than R), 328X (wherein X is an amino acid other than Y), 395K, 459X (wherein X is an amino acid other than S), 693 X (wherein X is an amino acid other than E), 767X (wherein X is an amino acid other than I), 830X (wherein X is an amino acid other than R), 897X (wherein X is an amino acid other than W), 1200L, 1235L, 1488X (wherein X is an amino acid other than R), 1659X (wherein X is an amino acid other than K), 1689X (wherein X is an amino acid other than W), 422D, 490N, 943L, 1002L, 1161W and 1919G, optionally, wherein the determining step is performed before administration of the antibody to the human.

9. The ligand of clause 8, wherein the step of determining comprises assaying a biological sample from the human for a nucleotide sequence encoding a Nav1.7 protein comprising said amino acid selected from the group consisting of 136I, 216S, 241T, 395K, 848T, 858H, 858F, 863P, 1449V, 996C, 1298F, 1298D, 1299F, 1461T, 1462V, 14641, 1627K, 277X (wherein X is an amino acid other than R), 328X (wherein X is an amino acid other than Y), 395K, 459X (wherein X is an amino acid other than S), 693 X (wherein X is an amino acid other than E), 767X (wherein X is an amino acid other than I), 830X (wherein X is an amino acid other than R), 897X (wherein X is an amino acid other than W), 1200L, 1235L, 1488X (wherein X is an amino acid other than R), 1659X (wherein X is an amino acid other than K), 1689X (wherein X is an amino acid other than W), 422D, 490N, 943L, 1002L, 1161W and 1919G.

10. The ligand of clause 9, wherein the assaying comprises contacting the biological sample with at least one oligonucleotide probe comprising a sequence of at least 10 contiguous nucleotides of a nucleotide sequence encoding a Nav1.7 protein comprising said amino acid selected from the group consisting of 136I, 216S, 241T, 395K, 848T, 858H, 858F, 863P, 1449V, 996C, 1298F, 1298D, 1299F, 1461T, 1462V, 14641, 1627K, 277X (wherein X is an amino acid other than R), 328X (wherein X is an amino acid other than Y), 395K, 459X (wherein X is an amino acid other than S), 693 X (wherein X is an amino acid other than E), 767X (wherein X is an amino acid other than I), 830X (wherein X is an amino acid other than R), 897X (wherein X is an amino acid other than W), 1200L, 1235L, 1488X (wherein X is an amino acid other than R), 1659X (wherein X is an amino acid other than K), 1689X (wherein X is an amino acid other than W), 422D, 490N, 943L, 1002L, 1161W and 1919G or comprising an antisense sequence of said contiguous nucleotides, wherein said sequence of contiguous nucleotides comprises a nucleotide sequence encoding said amino acid selected from the group consisting of 136I, 216S, 241T, 395K, 848T, 858H, 858F, 863P, 1449V, 996C, 1298F, 1298D, 1299F, 1461T, 1462V, 14641, 1627K, 277X (wherein X is an amino acid other than R), 328X (wherein X is an amino acid other than Y), 395K, 459X (wherein X is an amino acid other than S), 693 X (wherein X is an amino acid other than E), 767X (wherein X is an amino acid other than I), 830X (wherein X is an amino acid other than R), 897X (wherein X is an amino acid other than W), 1200L, 1235L, 1488X (wherein X is an amino acid other than R), 1659X (wherein X is an amino acid other than K), 1689X (wherein X is an amino acid other than W), 422D, 490N, 943L, 1002L, 1161W and 1919G, thereby forming a complex when at least one nucleotide sequence encoding the Nav1.7 protein comprising said amino acid selected from the group consisting of 136I, 216S, 241T, 395K, 848T, 858H, 858F, 863P, 1449V, 996C, 1298F, 1298D, 1299F, 1461T, 1462V, 14641, 1627K, 277X (wherein X is an amino acid other than R), 328X (wherein X is an amino acid other than Y), 395K, 459X (wherein X is an amino acid other than S), 693 X (wherein X is an amino acid other than E), 767X (wherein X is an amino acid other than I), 830X (wherein X is an amino acid other than R), 897X (wherein X is an amino acid other than W), 1200L, 1235L, 1488X (wherein X is an amino acid other than R), 1659X (wherein X is an amino acid other than K), 1689X (wherein X is an amino acid other than W), 422D, 490N, 943L, 1002L, 1161W and 1919G is present; and detecting the presence or absence of the complex, wherein detecting the presence of the complex determines that the human comprises the Nav1.7 protein comprising said amino acid selected from the group consisting of 136I, 216S, 241T, 395K, 848T, 858H, 858F, 863P, 1449V, 996C, 1298F, 1298D, 1299F, 1461T, 1462V, 14641, 1627K, 277X (wherein X is an amino acid other than R), 328X (wherein X is an amino acid other than Y), 395K, 459X (wherein X is an amino acid other than S), 693 X (wherein X is an amino acid other than E), 767X (wherein X is an amino acid other than I), 830X (wherein X is an amino acid other than R), 897X (wherein X is an amino acid other than W), 1200L, 1235L, 1488X (wherein X is an amino acid other than R), 1659X (wherein X is an amino acid other than K), 1689X (wherein X is an amino acid other than W), 422D, 490N, 943L, 1002L, 1161W and 1919G.

11. The ligand of clause 9, wherein the assaying comprises nucleic acid amplification and optionally one or more methods selected from sequencing, next generation sequencing, nucleic acid hybridization, and allele-specific amplification and/or wherein the assaying is performed in a multiplex format.

12. The ligand of clause 9 or 11, wherein said biological sample comprises serum, blood, feces, tissue, a cell, urine and/or saliva of said human.

13. The ligand of any preceding clause, wherein said human is indicated as heterozygous for a nucleotide sequence encoding the Nav1.7 protein comprising said amino acid selected from the group consisting of 136I, 216S, 241T, 395K, 848T, 858H, 858F, 863P, 1449V, 996C, 1298F, 1298D, 1299F, 1461T, 1462V, 14641, 1627K, 277X (wherein X is an amino acid other than R), 328X (wherein X is an amino acid other than Y), 395K, 459X (wherein X is an amino acid other than S), 693 X (wherein X is an amino acid other than E), 767X (wherein X is an amino acid other than I), 830X (wherein X is an amino acid other than R), 897X (wherein X is an amino acid other than W), 1200L, 1235L, 1488X (wherein X is an amino acid other than R), 1659X (wherein X is an amino acid other than K), 1689X (wherein X is an amino acid other than W), 422D, 490N, 943L, 1002L, 1161W and 1919G, optionally, wherein said human is further indicated as comprising the nucleotide sequence of SEQ ID NO: 76, or said human is indicated as homozygous for a nucleotide sequence encoding the Nav1.7 protein comprising said amino acid selected from the group consisting of 136I, 216S, 241T, 395K, 848T, 858H, 858F, 863P, 1449V, 996C, 1298F, 1298D, 1299F, 1461T, 1462V, 1464I, 1627K, 277X (wherein X is an amino acid other than R), 328X (wherein X is an amino acid other than Y), 395K, 459X (wherein X is an amino acid other than S), 693 X (wherein X is an amino acid other than E), 767X (wherein X is an amino acid other than I), 830X (wherein X is an amino acid other than R), 897X (wherein X is an amino acid other than W), 1200L, 1235L, 1488X (wherein X is an amino acid other than R), 1659X (wherein X is an amino acid other than K), 1689X (wherein X is an amino acid other than W), 422D, 490N, 943L, 1002L, 1161W and 1919G.

14. The ligand of any preceding clause, wherein said human is or has been further determined to be substantially resistant to a pain or itching treatment.
15. The ligand of any preceding clause, wherein said human is receiving or has received a pain or itching treatment or has reduced responsiveness to a pain or itching treatment.
16. The ligand of any preceding clause, wherein said disease or condition is a pain or itching disease or condition.
17. The ligand of any preceding clause, wherein said disease or condition is a channelopathy or associated with a channelopathy; or is selected from the group consisting of primary erythermalgia (PE), paroxysmal extreme pain disorder (PEPD) and channelopathy-associated insensitivity to pain (CIP).
18. The ligand of any preceding clause, wherein said human has been diagnosed with at least one condition recited in clause 16 or 17.
19. The ligand of any preceding clause, wherein said antibody or antibody fragment treats or reduces the risk in said human of a condition recited in clause 16 or 17.
20. The ligand of any preceding clause, wherein the nucleotide sequence comprises one or more SNPs selected from the group consisting of rs6746030, rs3750904, rs58022607, rs4369876, rs13402180 and rs12478318.
21. The ligand of any preceding clause, wherein said ligand (eg, antibody or antibody fragment) is for inhaled, intravenous or subcutaneous administration and/or is comprised in an inhalable or injectable preparation.

Methods with Gamma-4 Constant Region Tailoring

1. A method of treating or reducing the risk of a Nav1.7-mediated disease or condition in a human in need thereof, the method comprising administering to said human a ligand (eg, an antibody or antibody fragment) that specifically binds a huma Nav1.7 protein that comprises an amino acid selected from the group consisting of 136I, 216S, 241T, 395K, 848T, 858H, 858F, 863P, 1449V, 996C, 1298F, 1298D, 1299F, 1461T, 1462V, 1464I, 1627K, 277X (wherein X is an amino acid other than R), 328X (wherein X is an amino acid other than Y), 395K, 459X (wherein X is an amino acid other than S), 693 X (wherein X is an amino acid other than E), 767X (wherein X is an amino acid other than I), 830X (wherein X is an amino acid other than R), 897X (wherein X is an amino acid other than W), 1200L, 1235L, 1488X (wherein X is an amino acid other than R), 1659X (wherein X is an amino acid other than K), 1689X (wherein X is an amino acid other than W), 422D, 490N, 943L, 1002L, 1161W and 1919G;

wherein (i) the ligand comprises a human gamma-4 heavy chain constant region that comprises a Leu at position 189 shown in SEQ ID NO: 73 or an Arg at position 289 shown in SEQ ID NO: 73 and wherein said human comprises (i) an IGHG4*01 human heavy chain constant region gene segment, or the human expresses antibodies comprising human gamma-4 heavy chain constant regions comprising a Leu at position 189 shown in SEQ ID NO: 73 or an Arg at position 289 shown in SEQ ID NO: 73; and wherein (ii) said human comprises a nucleotide sequence encoding said Nav1.7 protein comprising said amino acid selected from the group consisting of 136I, 216S, 241T, 395K, 848T, 858H, 858F, 863P, 1449V, 996C, 1298F, 1298D, 1299F, 1461T, 1462V, 1464I, 1627K, 277X (wherein X is an amino acid other than R), 328X (wherein X is an amino acid other than Y), 395K, 459X (wherein X is an amino acid other than S), 693 X (wherein X is an amino acid other than E), 767X (wherein X is an amino acid other than I), 830X (wherein X is an amino acid other than R), 897X (wherein X is an amino acid other than W), 1200L, 1235L, 1488X (wherein X is an amino acid other than R), 1659X (wherein X is an amino acid other than K), 1689X (wherein X is an amino acid other than W), 422D, 490N, 943L, 1002L, 1161W and 1919G.

In an alternative, clause 1 provides:—

A method of targeting Nav1.7 in a human, the method comprising administering to said human a ligand (eg, an antibody or antibody fragment) that specifically binds a huma Nav1.7 protein that comprises an amino acid selected from the group consisting of 136I, 216S, 241T, 395K, 848T, 858H, 858F, 863P, 1449V, 996C, 1298F, 1298D, 1299F, 1461T, 1462V, 1464I, 1627K, 277X (wherein X is an amino acid other than R), 328X (wherein X is an amino acid other than Y), 395K, 459X (wherein X is an amino acid other than S), 693 X (wherein X is an amino acid other than E), 767X (wherein X is an amino acid other than I), 830X (wherein X is an amino acid other than R), 897X (wherein X is an amino acid other than W), 1200L, 1235L, 1488X (wherein X is an amino acid other than R), 1659X (wherein X is an amino acid other than K), 1689X (wherein X is an amino acid other than W), 422D, 490N, 943L, 1002L, 1161W and 1919G;

wherein (i) the ligand comprises a human gamma-4 heavy chain constant region that comprises a Leu at position 189 shown in SEQ ID NO: 73 or an Arg at position 289 shown in SEQ ID NO: 73 and wherein said human comprises (i) an IGHG4*01 human heavy chain constant region gene segment, or the human expresses antibodies comprising human gamma-4 heavy chain constant regions comprising a Leu at position 189 shown in SEQ ID NO: 73 or an Arg at position 289 shown in SEQ ID NO: 73; and wherein (ii) said human comprises a nucleotide sequence encoding said Nav1.7 protein comprising said amino acid selected from the group consisting of 136I, 216S, 241T, 395K, 848T, 858H, 858F, 863P, 1449V, 996C, 1298F, 1298D, 1299F, 1461T, 1462V, 1464I, 1627K, 277X (wherein X is an amino acid other than R), 328X (wherein X is an amino acid other than Y), 395K, 459X (wherein X is an amino acid other than S), 693 X (wherein X is an amino acid other than E), 767X (wherein X is an amino acid other than I), 830X (wherein X is an amino acid other than R), 897X (wherein X is an amino acid other than W), 1200L, 1235L, 1488X (wherein X is an amino acid other than R), 1659X (wherein X is an amino acid other than K), 1689X (wherein X is an amino acid other than W), 422D, 490N, 943L, 1002L, 1161W and 1919G.

In an example, the human is suffering from or at risk of a Nav1.7-mediated disease or condition.

In an example, the method treats or reduces the risk of a Nav1.7-mediated disease or condition in the human.

2. The method of any preceding clause, wherein said amino acid is selected from the group consisting of any one of 136I, 216S, 241T, 395K, 848T, 858H, 858F, 863P and 1449V; optionally wherein said disease or condition is a pain disease or condition.
3. The method of any preceding clause, wherein said amino acid is selected from the group consisting of 996C, 1298F, 1298D, 1299F, 1461T, 1462V, 1464I and 1627K; optionally wherein said disease or condition is a pain disease or condition.
4. The method of any preceding clause, wherein said amino acid is selected from the group consisting of 277X (wherein X is an amino acid other than R), 328X (wherein X is an amino acid other than Y), 395K, 459X (wherein X is an amino acid other than S), 693 X (wherein X is an amino acid other than E), 767X (wherein X is an amino acid other than I), 830X (wherein X is an amino acid other than R), 897X (wherein X is an amino acid other than W), 1200L, 1235L, 1488X (wherein X is an amino acid other than R), 1659X (wherein X is an amino acid other than K) and 1689X (wherein X is an amino acid other than W); optionally wherein said disease or condition is a pain disease or condition.
5. The method of any preceding clause, wherein the constant region gene segment comprised by said human is a germline gene segment.
6. The method of any preceding clause comprising, before said administering, selecting a human comprising said nucleotide sequence of (ii), wherein the human is the human of clause 1.
7. The method of any preceding clause, wherein the human has been determined to comprise the nucleotide sequence that encodes a Nav1.7 protein comprising said amino acid selected from the group consisting of 136I, 216S, 241T, 395K, 848T, 858H, 858F, 863P, 1449V, 996C, 1298F, 1298D, 1299F, 1461T, 1462V, 1464I, 1627K, 277X (wherein X is an amino acid other than R), 328X (wherein X is an amino acid other than Y), 395K, 459X (wherein X is an amino acid other than S), 693 X (wherein X is an amino acid other than E), 767X (wherein X is an amino acid other than I), 830X (wherein X is an amino acid other than R), 897X (wherein X is an amino acid other than W), 1200L, 1235L, 1488X (wherein X is an amino acid other than R), 1659X (wherein X is an amino acid other than K), 1689X (wherein X is an amino acid other than W), 422D, 490N, 943L, 1002L, 1161W and 1919G and/or a Nav1.7 protein comprising said amino acid selected from the group consisting of 136I, 216S, 241T, 395K, 848T, 858H, 858F, 863P, 1449V, 996C, 1298F, 1298D, 1299F, 1461T, 1462V, 1464I, 1627K, 277X (wherein X is an amino acid other than R), 328X (wherein X is an amino acid other than Y), 395K, 459X (wherein X is an amino acid other than S), 693 X (wherein X is an amino acid other than E), 767X (wherein X is an amino acid other than I), 830X (wherein X is an amino acid other than R), 897X (wherein X is an amino acid other than W), 1200L, 1235L, 1488X (wherein X is an amino acid other than R), 1659X (wherein X is an amino acid other than K), 1689X (wherein X is an amino acid other than W), 422D, 490N, 943L, 1002L, 1161W and 1919G.
8. The method of any preceding clause, comprising the step of determining that the human comprises (a) the nucleotide sequence that encodes a Nav1.7 protein comprising said amino acid selected from the group consisting of 136I, 216S, 241T, 395K, 848T, 858H, 858F, 863P, 1449V, 996C, 1298F, 1298D, 1299F, 1461T, 1462V, 1464I, 1627K, 277X (wherein X is an amino acid other than R), 328X (wherein X is an amino acid other than Y), 395K, 459X (wherein X is an amino acid other than S), 693 X (wherein X is an amino acid other than E), 767X (wherein X is an amino acid other than I), 830X (wherein X is an amino acid other than R), 897X (wherein X is an amino acid other than W), 1200L, 1235L, 1488X (wherein X is an amino acid other than R), 1659X (wherein X is an amino acid other than K), 1689X (wherein X is an amino acid other than W), 422D, 490N, 943L, 1002L, 1161W and 1919G and/or (b) a Nav1.7 protein comprising said amino acid selected from the group consisting of 136I, 216S, 241T, 395K, 848T, 858H, 858F, 863P, 1449V, 996C, 1298F, 1298D, 1299F, 1461T, 1462V, 1464I, 1627K, 277X (wherein X is an amino acid other than R), 328X (wherein X is an amino acid other than Y), 395K, 459X (wherein X is an amino acid other than S), 693 X (wherein X is an amino acid other than E), 767X (wherein X is an amino acid other than I), 830X (wherein X is an amino acid other than R), 897X (wherein X is an amino acid other than W), 1200L, 1235L, 1488X (wherein X is an amino acid other than R), 1659X (wherein X is an amino acid other than K), 1689X (wherein X is an amino acid other than W), 422D, 490N, 943L, 1002L, 1161W and 1919G, optionally, wherein the determining step is performed before administration of the antibody to the human.
9. The method of clause 8, wherein the step of determining comprises assaying a biological sample from the human for a nucleotide sequence encoding a Nav1.7 protein comprising said amino acid selected from the group consisting of 136I, 216S, 241T, 395K, 848T, 858H, 858F, 863P, 1449V, 996C, 1298F, 1298D, 1299F, 1461T, 1462V, 1464I, 1627K, 277X (wherein X is an amino acid other than R), 328X (wherein X is an amino acid other than Y), 395K, 459X (wherein X is an amino acid other than S), 693 X (wherein X is an amino acid other than E), 767X (wherein X is an amino acid other than I), 830X (wherein X is an amino acid other than R), 897X (wherein X is an amino acid other than W), 1200L, 1235L, 1488X (wherein X is an amino acid other than R), 1659X (wherein X is an amino acid other than K), 1689X (wherein X is an amino acid other than W), 422D, 490N, 943L, 1002L, 1161W and 1919G.
10. The method of clause 9, wherein the assaying comprises contacting the biological sample with at least one oligonucleotide probe comprising a sequence of at least 10 contiguous nucleotides of a nucleotide sequence encoding a Nav1.7 protein comprising said amino acid selected from the group consisting of 136I, 216S, 241T, 395K, 848T, 858H, 858F, 863P, 1449V, 996C, 1298F, 1298D, 1299F, 1461T, 1462V, 1464I, 1627K, 277X (wherein X is an amino acid other than R), 328X (wherein X is an amino acid other than Y), 395K, 459X (wherein X is an amino acid other than S), 693 X (wherein X is an amino acid other than E), 767X (wherein X is an amino acid other than I), 830X (wherein X is an amino acid other than R), 897X (wherein X is an amino acid other than W), 1200L, 1235L, 1488X (wherein X is an amino acid other than R), 1659X (wherein X is an amino acid other than K), 1689X (wherein X is an amino acid other than W), 422D, 490N, 943L, 1002L, 1161W and 1919G or comprising an antisense sequence of said contiguous nucleotides, wherein said sequence of contiguous nucleotides comprises a nucleotide sequence encoding said amino acid selected from the group consisting of 136I, 216S, 241T, 395K, 848T, 858H, 858F, 863P, 1449V, 996C, 1298F, 1298D, 1299F, 1461T, 1462V, 1464I, 1627K, 277X (wherein X is an amino acid other than R), 328X (wherein X is an amino acid other than Y), 395K, 459X (wherein X is an amino acid other than S), 693 X (wherein X is an amino acid other than E), 767X (wherein X is an amino acid other than I), 830X (wherein X is an amino acid other than R), 897X (wherein X is an amino acid other than W), 1200L, 1235L, 1488X (wherein X is an amino acid other than R), 1659X (wherein X is an amino acid other than K), 1689X (wherein X is an amino acid other than W), 422D, 490N, 943L, 1002L, 1161W and 1919G, thereby forming a complex when at least one nucleotide sequence encoding the Nav1.7 protein comprising said amino acid selected from the group consisting of 136I, 216S, 241T, 395K, 848T, 858H, 858F, 863P, 1449V, 996C, 1298F, 1298D, 1299F, 1461T, 1462V, 1464I, 1627K, 277X (wherein X is an amino acid other than R), 328X (wherein X is an amino acid other than Y), 395K, 459X (wherein X is an amino acid other than S), 693 X (wherein X is an amino acid other than E), 767X (wherein X is an amino acid other than I), 830X (wherein X is an amino acid other than R), 897X (wherein X is an amino acid other than W), 1200L, 1235L, 1488X (wherein X is an amino acid other than R), 1659X (wherein X is an amino acid other than K), 1689X (wherein X is an amino acid other than W), 422D, 490N, 943L, 1002L, 1161W and 1919G is present; and detecting the presence or absence of the complex, wherein detecting the presence of the complex determines that the human comprises the Nav1.7 protein comprising said amino acid selected from the group consisting of 136I, 216S, 241T, 395K, 848T, 858H, 858F, 863P, 1449V, 996C, 1298F, 1298D, 1299F, 1461T, 1462V, 1464I, 1627K, 277X (wherein X is an amino acid other than R), 328X (wherein X is an amino acid other than Y), 395K, 459X (wherein X is an amino acid other than S), 693 X (wherein X is an amino acid other than E), 767X (wherein X is an amino acid other than I), 830X (wherein X is an amino acid other than R), 897X (wherein X is an amino acid other than W), 1200L, 1235L, 1488X (wherein X is an amino acid other than R), 1659X (wherein X is an amino acid other than K), 1689X (wherein X is an amino acid other than W), 422D, 490N, 943L, 1002L, 1161W and 1919G.

11. The method of clause 9, wherein the assaying comprises nucleic acid amplification and optionally one or more methods selected from sequencing, next generation sequencing, nucleic acid hybridization, and allele-specific amplification and/or wherein the assaying is performed in a multiplex format.

12. The method of clause 9 or 11, wherein said biological sample comprises serum, blood, feces, tissue, a cell, urine and/or saliva of said human.

13. The method of any preceding clause, wherein said human is indicated as heterozygous for a nucleotide sequence encoding the Nav1.7 protein comprising said amino acid selected from the group consisting of 136I, 216S, 241T, 395K, 848T, 858H, 858F, 863P, 1449V, 996C, 1298F, 1298D, 1299F, 1461T, 1462V, 1464I, 1627K, 277X (wherein X is an amino acid other than R), 328X (wherein X is an amino acid other than Y), 395K, 459X (wherein X is an amino acid other than S), 693 X (wherein X is an amino acid other than E), 767X (wherein X is an amino acid other than I), 830X (wherein X is an amino acid other than R), 897X (wherein X is an amino acid other than W), 1200L, 1235L, 1488X (wherein X is an amino acid other than R), 1659X (wherein X is an amino acid other than K), 1689X (wherein X is an amino acid other than W), 422D, 490N, 943L, 1002L, 1161W and 1919G, optionally, wherein said human is further indicated as comprising the nucleotide sequence of SEQ ID NO: 76, or said human is indicated as homozygous for a nucleotide sequence encoding the Nav1.7 protein comprising said amino acid selected from the group consisting of 136I, 216S, 241T, 395K, 848T, 858H, 858F, 863P, 1449V, 996C, 1298F, 1298D, 1299F, 1461T, 1462V, 1464I, 1627K, 277X (wherein X is an amino acid other than R), 328X (wherein X is an amino acid other than Y), 395K, 459X (wherein X is an amino acid other than S), 693 X (wherein X is an amino acid other than E), 767X (wherein X is an amino acid other than I), 830X (wherein X is an amino acid other than R), 897X (wherein X is an amino acid other than W), 1200L, 1235L, 1488X (wherein X is an amino acid other than R), 1659X (wherein X is an amino acid other than K), 1689X (wherein X is an amino acid other than W), 422D, 490N, 943L, 1002L, 1161W and 1919G.

14. The method of any preceding clause, wherein said human is or has been further determined to be substantially resistant to a pain or itching treatment.

15. The method of any preceding clause, wherein said human is receiving or has received a pain or itching treatment or has reduced responsiveness to a pain or itching treatment.

16. The method of any preceding clause, wherein said disease or condition is a pain or itching disease or condition.

17. The method of any preceding clause, wherein said disease or condition is a channelopathy or associated with a channelopathy; or is selected from the group consisting of primary erythermalgia (PE), paroxysmal extreme pain disorder (PEPD) and channelopathy-associated insensitivity to pain (CIP).

18. The method of any preceding clause, wherein said human has been diagnosed with at least one condition recited in clause 16 or 17.

19. The method of any preceding clause, wherein said antibody or antibody fragment treats or reduces the risk in said human of a condition recited in clause 16 or 17.

20. The method of any preceding clause, wherein the nucleotide sequence comprises one or more SNPs selected from the group consisting of rs6746030, rs3750904, rs58022607, rs4369876, rs13402180 and rs12478318.

21. The method of any preceding clause, wherein said ligand (eg, antibody or antibody fragment) is administered by inhaled, intravenous or subcutaneous administration and/or is comprised in an inhalable or injectable preparation.

22. The method of any preceding clause, wherein the human gamma-4 heavy chain constant region of the ligand comprises the amino acid sequence of SEQ ID NO: 73 or an ADCC inactivated version thereof.

23. The method of any preceding clause, wherein the human gamma-4 heavy chain constant region comprises 228P and 235E.

Ligands with Gamma-4 Constant Region Tailoring

1. A ligand (eg, an antibody or antibody fragment) for use in a method of treating or reducing the risk of a Nav1.7-mediated disease or condition (eg, pain) in a human in need thereof, wherein the ligand specifically binds a huma Nav1.7 protein that comprises an amino acid selected from the group consisting of 136I, 216S, 241T, 395K, 848T, 858H, 858F, 863P, 1449V, 996C, 1298F, 1298D, 1299F, 1461T, 1462V, 14641, 1627K, 277X (wherein X is an amino acid other than R), 328X (wherein X is an amino acid other than Y), 395K, 459X (wherein X is an amino acid other than S), 693 X (wherein X is an amino acid other than E), 767X (wherein X is an amino acid other than I), 830X (wherein X is an amino acid other than R), 897X (wherein X is an amino acid other than W), 1200L, 1235L, 1488X (wherein X is an amino acid other than R), 1659X (wherein X is an amino acid other than K), 1689X (wherein X is an amino acid other than W), 422D, 490N, 943L, 1002L, 1161W and 1919G;

wherein (i) the ligand comprises a human gamma-4 heavy chain constant region that comprises a Leu at position 189 shown in SEQ ID NO: 73 or an Arg at position 289 shown in SEQ ID NO: 73 and wherein said human comprises (i) an IGHG4*01 human heavy chain constant region gene segment, or the human expresses antibodies comprising human gamma-4 heavy chain constant regions comprising a Leu at position 189 shown in SEQ ID NO: 73 or an Arg at position 289 shown in SEQ ID NO: 73; and wherein (ii) said human comprises a nucleotide sequence encoding said Nav1.7 protein comprising said amino acid selected from the group consisting of 136I, 216S, 241T, 395K, 848T, 858H, 858F, 863P, 1449V, 996C, 1298F, 1298D, 1299F, 1461T, 1462V, 14641, 1627K, 277X (wherein X is an amino acid other than R), 328X (wherein X is an amino acid other than Y), 395K, 459X (wherein X is an amino acid other than S), 693 X (wherein X is an amino acid other than E), 767X (wherein X is an amino acid other than I), 830X (wherein X is an amino acid other than R), 897X (wherein X is an amino acid other than W), 1200L, 1235L, 1488X (wherein X is an amino acid other than R), 1659X (wherein X is an amino acid other than K), 1689X (wherein X is an amino acid other than W), 422D, 490N, 943L, 1002L, 1161W and 1919G.

In an alternative, paragraph 1 provides:—

A ligand (eg, an antibody or antibody fragment) for use in a method of targeting Nav1.7 in a human, wherein the ligand specifically binds a huma Nav1.7 protein that comprises an amino acid selected from the group consisting of 136I, 216S, 241T, 395K, 848T, 858H, 858F, 863P, 1449V, 996C, 1298F, 1298D, 1299F, 1461T, 1462V, 14641, 1627K, 277X (wherein X is an amino acid other than R), 328X (wherein X is an amino acid other than Y), 395K, 459X (wherein X is an amino acid other than S), 693 X (wherein X is an amino acid other than E), 767X (wherein X is an amino acid other than I), 830X (wherein X is an amino acid other than R), 897X (wherein X is an amino acid other than W), 1200L, 1235L, 1488X (wherein X is an amino acid other than R), 1659X (wherein X is an amino acid other than K), 1689X (wherein X is an amino acid other than W), 422D, 490N, 943L, 1002L, 1161W and 1919G;

wherein (i) the ligand comprises a human gamma-4 heavy chain constant region that comprises a Leu at position 189 shown in SEQ ID NO: 73 or an Arg at position 289 shown in SEQ ID NO: 73 and wherein said human comprises (i) an IGHG4*01 human heavy chain constant region gene segment, or the human expresses antibodies comprising human gamma-4 heavy chain constant regions comprising a Leu at position 189 shown in SEQ ID NO: 73 or an Arg at position 289 shown in SEQ ID NO: 73; and wherein (ii) said human comprises a nucleotide sequence encoding said Nav1.7 protein comprising said amino acid selected from the group consisting of 136I, 216S, 241T, 395K, 848T, 858H, 858F, 863P, 1449V, 996C, 1298F, 1298D, 1299F, 1461T, 1462V, 14641, 1627K, 277X (wherein X is an amino acid other than R), 328X (wherein X is an amino acid other than Y), 395K, 459X (wherein X is an amino acid other than S), 693 X (wherein X is an amino acid other than E), 767X (wherein X is an amino acid other than I), 830X (wherein X is an amino acid other than R), 897X (wherein X is an amino acid other than W), 1200L, 1235L, 1488X (wherein X is an amino acid other than R), 1659X (wherein X is an amino acid other than K), 1689X (wherein X is an amino acid other than W), 422D, 490N, 943L, 1002L, 1161W and 1919G.

In an example, the human is suffering from or at risk of a Nav1.7-mediated disease or condition.

In an example, the method treats or reduces the risk of a Nav1.7-mediated disease or condition in the human.

2. The ligand of any preceding clause, wherein said amino acid is selected from the group consisting of any one of 136I, 216S, 241T, 395K, 848T, 858H, 858F, 863P and 1449V; optionally wherein said disease or condition is a pain disease or condition.

3. The ligand of any preceding clause, wherein said amino acid is selected from the group consisting of 996C, 1298F, 1298D, 1299F, 1461T, 1462V, 14641 and 1627K; optionally wherein said disease or condition is a pain disease or condition.

4. The ligand of any preceding clause, wherein said amino acid is selected from the group consisting of 277X (wherein X is an amino acid other than R), 328X (wherein X is an amino acid other than Y), 395K, 459X (wherein X is an amino acid other than S), 693 X (wherein X is an amino acid other than E), 767X (wherein X is an amino acid other than I), 830X (wherein X is an amino acid other than R), 897X (wherein X is an amino acid other than W), 1200L, 1235L, 1488X (wherein X is an amino acid other than R), 1659X (wherein X is an amino acid other than K) and 1689X (wherein X is an amino acid other than W); optionally wherein said disease or condition is a pain disease or condition.

5. The ligand of any preceding clause, wherein the VH gene segment comprised by said human is a germline VH gene segment.

6. The ligand of any preceding clause said method comprising, before said administering, selecting a human comprising said nucleotide sequence of (ii), wherein the human is the human of clause 1.

7. The ligand of any preceding clause, wherein the human has been determined to comprise the nucleotide sequence that encodes a Nav1.7 protein comprising said amino acid selected from the group consisting of 136I, 216S, 241T, 395K, 848T, 858H, 858F, 863P, 1449V, 996C, 1298F, 1298D, 1299F, 1461T, 1462V, 14641, 1627K, 277X (wherein X is an amino acid other than R), 328X (wherein X is an amino acid other than Y), 395K, 459X (wherein X is an amino acid other than S), 693 X (wherein X is an amino acid other than E), 767X (wherein X is an amino acid other than I), 830X (wherein X is an amino acid other than R), 897X (wherein X is an amino acid other than W), 1200L, 1235L, 1488X (wherein X is an amino acid other than R), 1659X (wherein X is an amino acid other than K), 1689X (wherein X is an amino acid other than W), 422D, 490N, 943L, 1002L, 1161W and 1919G and/or a Nav1.7 protein comprising said amino acid selected from the group consisting of 136I, 216S, 241T, 395K, 848T, 858H, 858F, 863P, 1449V, 996C, 1298F, 1298D, 1299F, 1461T, 1462V, 1464I, 1627K, 277X (wherein X is an amino acid other than R), 328X (wherein X is an amino acid other than Y), 395K, 459X (wherein X is an amino acid other than S), 693 X (wherein X is an amino acid other than E), 767X (wherein X is an amino acid other than I), 830X (wherein X is an amino acid other than R), 897X (wherein X is an amino acid other than W), 1200L, 1235L, 1488X (wherein X is an amino acid other than R), 1659X (wherein X is an amino acid other than K), 1689X (wherein X is an amino acid other than W), 422D, 490N, 943L, 1002L, 1161W and 1919G.

8. The ligand of any preceding clause, said method comprising the step of determining that the human comprises (a) the nucleotide sequence that encodes a Nav1.7 protein comprising said amino acid selected from the group consisting of 136I, 216S, 241T, 395K, 848T, 858H, 858F, 863P, 1449V, 996C, 1298F, 1298D, 1299F, 1461T, 1462V, 1464I, 1627K, 277X (wherein X is an amino acid other than R), 328X (wherein X is an amino acid other than Y), 395K, 459X (wherein X is an amino acid other than S), 693 X (wherein X is an amino acid other than E), 767X (wherein X is an amino acid other than I), 830X (wherein X is an amino acid other than R), 897X (wherein X is an amino acid other than W), 1200L, 1235L, 1488X (wherein X is an amino acid other than R), 1659X (wherein X is an amino acid other than K), 1689X (wherein X is an amino acid other than W), 422D, 490N, 943L, 1002L, 1161W and 1919G and/or (b) a Nav1.7 protein comprising said amino acid selected from the group consisting of 136I, 216S, 241T, 395K, 848T, 858H, 858F, 863P, 1449V, 996C, 1298F, 1298D, 1299F, 1461T, 1462V, 1464I, 1627K, 277X (wherein X is an amino acid other than R), 328X (wherein X is an amino acid other than Y), 395K, 459X (wherein X is an amino acid other than S), 693 X (wherein X is an amino acid other than E), 767X (wherein X is an amino acid other than I), 830X (wherein X is an amino acid other than R), 897X (wherein X is an amino acid other than W), 1200L, 1235L, 1488X (wherein X is an amino acid other than R), 1659X (wherein X is an amino acid other than K), 1689X (wherein X is an amino acid other than W), 422D, 490N, 943L, 1002L, 1161W and 1919G, optionally, wherein the determining step is performed before administration of the antibody to the human.

9. The ligand of clause 8, wherein the step of determining comprises assaying a biological sample from the human for a nucleotide sequence encoding a Nav1.7 protein comprising said amino acid selected from the group consisting of 136I, 216S, 241T, 395K, 848T, 858H, 858F, 863P, 1449V, 996C, 1298F, 1298D, 1299F, 1461T, 1462V, 1464I, 1627K, 277X (wherein X is an amino acid other than R), 328X (wherein X is an amino acid other than Y), 395K, 459X (wherein X is an amino acid other than S), 693 X (wherein X is an amino acid other than E), 767X (wherein X is an amino acid other than I), 830X (wherein X is an amino acid other than R), 897X (wherein X is an amino acid other than W), 1200L, 1235L, 1488X (wherein X is an amino acid other than R), 1659X (wherein X is an amino acid other than K), 1689X (wherein X is an amino acid other than W), 422D, 490N, 943L, 1002L, 1161W and 1919G.

10. The ligand of clause 9, wherein the assaying comprises contacting the biological sample with at least one oligonucleotide probe comprising a sequence of at least 10 contiguous nucleotides of a nucleotide sequence encoding a Nav1.7 protein comprising said amino acid selected from the group consisting of 136I, 216S, 241T, 395K, 848T, 858H, 858F, 863P, 1449V, 996C, 1298F, 1298D, 1299F, 1461T, 1462V, 1464I, 1627K, 277X (wherein X is an amino acid other than R), 328X (wherein X is an amino acid other than Y), 395K, 459X (wherein X is an amino acid other than S), 693 X (wherein X is an amino acid other than E), 767X (wherein X is an amino acid other than I), 830X (wherein X is an amino acid other than R), 897X (wherein X is an amino acid other than W), 1200L, 1235L, 1488X (wherein X is an amino acid other than R), 1659X (wherein X is an amino acid other than K), 1689X (wherein X is an amino acid other than W), 422D, 490N, 943L, 1002L, 1161W and 1919G or comprising an antisense sequence of said contiguous nucleotides, wherein said sequence of contiguous nucleotides comprises a nucleotide sequence encoding said amino acid selected from the group consisting of 136I, 216S, 241T, 395K, 848T, 858H, 858F, 863P, 1449V, 996C, 1298F, 1298D, 1299F, 1461T, 1462V, 1464I, 1627K, 277X (wherein X is an amino acid other than R), 328X (wherein X is an amino acid other than Y), 395K, 459X (wherein X is an amino acid other than S), 693 X (wherein X is an amino acid other than E), 767X (wherein X is an amino acid other than I), 830X (wherein X is an amino acid other than R), 897X (wherein X is an amino acid other than W), 1200L, 1235L, 1488X (wherein X is an amino acid other than R), 1659X (wherein X is an amino acid other than K), 1689X (wherein X is an amino acid other than W), 422D, 490N, 943L, 1002L, 1161W and 1919G, thereby forming a complex when at least one nucleotide sequence encoding the Nav1.7 protein comprising said amino acid selected from the group consisting of 136I, 216S, 241T, 395K, 848T, 858H, 858F, 863P, 1449V, 996C, 1298F, 1298D, 1299F, 1461T, 1462V, 1464I, 1627K, 277X (wherein X is an amino acid other than R), 328X (wherein X is an amino acid other than Y), 395K, 459X (wherein X is an amino acid other than S), 693 X (wherein X is an amino acid other than E), 767X (wherein X is an amino acid other than I), 830X (wherein X is an amino acid other than R), 897X (wherein X is an amino acid other than W), 1200L, 1235L, 1488X (wherein X is an amino acid other than R), 1659X (wherein X is an amino acid other than K), 1689X (wherein X is an amino acid other than W), 422D, 490N, 943L, 1002L, 1161W and 1919G is present; and detecting the presence or absence of the complex, wherein detecting the presence of the complex determines that the human comprises the Nav1.7 protein comprising said amino acid selected from the group consisting of 136I, 216S, 241T, 395K, 848T, 858H, 858F, 863P, 1449V, 996C, 1298F, 1298D, 1299F, 1461T, 1462V, 1464I, 1627K, 277X (wherein X is an amino acid other than R), 328X (wherein X is an amino acid other than Y), 395K, 459X (wherein X is an amino acid other than S), 693 X (wherein X is an amino acid other than E), 767X (wherein X is an amino acid other than I), 830X (wherein X is an amino acid other than R), 897X (wherein X is an amino acid other than W), 1200L, 1235L, 1488X (wherein X is an amino acid other than R), 1659X (wherein X is an amino acid other than K), 1689X (wherein X is an amino acid other than W), 422D, 490N, 943L, 1002L, 1161W and 1919G.
11. The ligand of clause 9, wherein the assaying comprises nucleic acid amplification and optionally one or more methods selected from sequencing, next generation sequencing, nucleic acid hybridization, and allele-specific amplification and/or wherein the assaying is performed in a multiplex format.
12. The ligand of clause 9 or 11, wherein said biological sample comprises serum, blood, feces, tissue, a cell, urine and/or saliva of said human.
13. The ligand of any preceding clause, wherein said human is indicated as heterozygous for a nucleotide sequence encoding the Nav1.7 protein comprising said amino acid selected from the group consisting of 136I, 216S, 241T, 395K, 848T, 858H, 858F, 863P, 1449V, 996C, 1298F, 1298D, 1299F, 1461T, 1462V, 1464I, 1627K, 277X (wherein X is an amino acid other than R), 328X (wherein X is an amino acid other than Y), 395K, 459X (wherein X is an amino acid other than S), 693 X (wherein X is an amino acid other than E), 767X (wherein X is an amino acid other than I), 830X (wherein X is an amino acid other than R), 897X (wherein X is an amino acid other than W), 1200L, 1235L, 1488X (wherein X is an amino acid other than R), 1659X (wherein X is an amino acid other than K), 1689X (wherein X is an amino acid other than W), 422D, 490N, 943L, 1002L, 1161W and 1919G, optionally, wherein said human is further indicated as comprising the nucleotide sequence of SEQ ID NO: 76, or said human is indicated as homozygous for a nucleotide sequence encoding the Nav1.7 protein comprising said amino acid selected from the group consisting of 136I, 216S, 241T, 395K, 848T, 858H, 858F, 863P, 1449V, 996C, 1298F, 1298D, 1299F, 1461T, 1462V, 1464I, 1627K, 277X (wherein X is an amino acid other than R), 328X (wherein X is an amino acid other than Y), 395K, 459X (wherein X is an amino acid other than S), 693 X (wherein X is an amino acid other than E), 767X (wherein X is an amino acid other than I), 830X (wherein X is an amino acid other than R), 897X (wherein X is an amino acid other than W), 1200L, 1235L, 1488X (wherein X is an amino acid other than R), 1659X (wherein X is an amino acid other than K), 1689X (wherein X is an amino acid other than W), 422D, 490N, 943L, 1002L, 1161W and 1919G.
14. The ligand of any preceding clause, wherein said human is or has been further determined to be substantially resistant to a pain or itching treatment.
15. The ligand of any preceding clause, wherein said human is receiving or has received a pain or itching treatment or has reduced responsiveness to a pain or itching treatment.
16. The ligand of any preceding clause, wherein said disease or condition is a pain or itching disease or condition.
17. The ligand of any preceding clause, wherein said disease or condition is a channelopathy or associated with a channelopathy; or is selected from the group consisting of primary erythermalgia (PE), paroxysmal extreme pain disorder (PEPD) and channelopathy-associated insensitivity to pain (CIP).
18. The ligand of any preceding clause, wherein said human has been diagnosed with at least one condition recited in clause 16 or 17.
19. The ligand of any preceding clause, wherein said antibody or antibody fragment treats or reduces the risk in said human of a condition recited in clause 16 or 17.
20. The ligand of any preceding clause, wherein the nucleotide sequence comprises one or more SNPs selected from the group consisting of rs6746030, rs3750904, rs58022607, rs4369876, rs13402180 and rs12478318.
21. The ligand of any preceding clause, wherein said ligand (eg, antibody or antibody fragment) is for inhaled, intravenous or subcutaneous administration and/or is comprised in an inhalable or injectable preparation.
22. The ligand of any preceding clause, wherein the human gamma-4 heavy chain constant region of the ligand comprises the amino acid sequence of SEQ ID NO: 73 or an ADCC inactivated version thereof.
23. The ligand of any preceding clause, wherein the human gamma-4 heavy chain constant region comprises 228P and 235E.

Methods with Gamma-2 Constant Region Tailoring

1. A method of treating or reducing the risk of a Nav1.7-mediated disease or condition in a human in need thereof, the method comprising administering to said human a ligand (eg, an antibody or antibody fragment) that specifically binds a huma Nav1.7 protein that comprises an amino acid selected from the group consisting of 136I, 216S, 241T, 395K, 848T, 858H, 858F, 863P, 1449V, 996C, 1298F, 1298D, 1299F, 1461T, 1462V, 1464I, 1627K, 277X (wherein X is an amino acid other than R), 328X (wherein X is an amino acid other than Y), 395K, 459X (wherein X is an amino acid other than S), 693 X (wherein X is an amino acid other than E), 767X (wherein X is an amino acid other than I), 830X (wherein X is an amino acid other than R), 897X (wherein X is an amino acid other than W), 1200L, 1235L, 1488X (wherein X is an amino acid other than R), 1659X (wherein X is an amino acid other than K), 1689X (wherein X is an amino acid other than W), 422D, 490N, 943L, 1002L, 1161W and 1919G;

wherein (i) the ligand comprises a human gamma-2 heavy chain constant region that comprises an amino acid selected from the group consisting of a Pro at position 72 shown in SEQ ID NO: 6, an Asn at position 75 shown in SEQ ID NO: 6, a Phe at position 76 shown in SEQ ID NO: 6, a Val at position 161 shown in SEQ ID NO: 6 and an Ala at position 257 shown in SEQ ID NO: 6 and wherein said human comprises (i) an IGHG2*01 human heavy chain constant region gene segment, or the human expresses antibodies comprising human gamma-2 heavy chain constant regions comprising said selected Pro at position 72 shown in SEQ ID NO: 6, Asn at position 75 shown in SEQ ID NO: 6, Phe at position 76 shown in SEQ ID NO: 6, Val at position 161 shown in SEQ ID NO: 6 or Ala at position 257 shown in SEQ ID NO: 6; and wherein (ii) said human comprises a nucleotide sequence encoding said Nav1.7 protein comprising said amino acid selected from the group consisting of 136I, 216S, 241T, 395K, 848T, 858H, 858F, 863P, 1449V, 996C, 1298F, 1298D, 1299F, 1461T, 1462V, 1464I, 1627K, 277X (wherein X is an amino acid other than R), 328X (wherein X is an amino acid other than Y), 395K, 459X (wherein X is an amino acid other than S), 693 X (wherein X is an amino acid other than E), 767X (wherein X is an amino acid other than I), 830X (wherein X is an amino acid other than R), 897X (wherein X is an amino acid other than W), 1200L, 1235L, 1488X (wherein X is an amino acid other than R), 1659X (wherein X is an amino acid other than K), 1689X (wherein X is an amino acid other than W), 422D, 490N, 943L, 1002L, 1161W and 1919G.

In an alternative, clause 1 provides:—

A method of targeting Nav1.7 in a human, the method comprising administering to said human a ligand (eg, an antibody or antibody fragment) that specifically binds a huma Nav1.7 protein that comprises an amino acid selected from the group consisting of 136I, 216S, 241T, 395K, 848T, 858H, 858F, 863P, 1449V, 996C, 1298F, 1298D, 1299F, 1461T, 1462V, 1464I, 1627K, 277X (wherein X is an amino acid other than R), 328X (wherein X is an amino acid other than Y), 395K, 459X (wherein X is an amino acid other than S), 693 X (wherein X is an amino acid other than E), 767X (wherein X is an amino acid other than I), 830X (wherein X is an amino acid other than R), 897X (wherein X is an amino acid other than W), 1200L, 1235L, 1488X (wherein X is an amino acid other than R), 1659X (wherein X is an amino acid other than K), 1689X (wherein X is an amino acid other than W), 422D, 490N, 943L, 1002L, 1161W and 1919G;

wherein (i) the ligand comprises a human gamma-2 heavy chain constant region that comprises an amino acid selected from the group consisting of a Pro at position 72 shown in SEQ ID NO: 6, an Asn at position 75 shown in SEQ ID NO: 6, a Phe at position 76 shown in SEQ ID NO: 6, a Val at position 161 shown in SEQ ID NO: 6 and an Ala at position 257 shown in SEQ ID NO: 6 and wherein said human comprises (i) an IGHG2*01 human heavy chain constant region gene segment, or the human expresses antibodies comprising human gamma-2 heavy chain constant regions comprising said selected Pro at position 72 shown in SEQ ID NO: 6, Asn at position 75 shown in SEQ ID NO: 6, Phe at position 76 shown in SEQ ID NO: 6, Val at position 161 shown in SEQ ID NO: 6 or Ala at position 257 shown in SEQ ID NO: 6; and wherein (ii) said human comprises a nucleotide sequence encoding said Nav1.7 protein comprising said amino acid selected from the group consisting of 136I, 216S, 241T, 395K, 848T, 858H, 858F, 863P, 1449V, 996C, 1298F, 1298D, 1299F, 1461T, 1462V, 1464I, 1627K, 277X (wherein X is an amino acid other than R), 328X (wherein X is an amino acid other than Y), 395K, 459X (wherein X is an amino acid other than S), 693 X (wherein X is an amino acid other than E), 767X (wherein X is an amino acid other than I), 830X (wherein X is an amino acid other than R), 897X (wherein X is an amino acid other than W), 1200L, 1235L, 1488X (wherein X is an amino acid other than R), 1659X (wherein X is an amino acid other than K), 1689X (wherein X is an amino acid other than W), 422D, 490N, 943L, 1002L, 1161W and 1919G.

In an example, the human is suffering from or at risk of a Nav1.7-mediated disease or condition.

In an example, the method treats or reduces the risk of a Nav1.7-mediated disease or condition in the human.

2. The method of any preceding clause, wherein said amino acid is selected from the group consisting of any one of 136I, 216S, 241T, 395K, 848T, 858H, 858F, 863P and 1449V; optionally wherein said disease or condition is a pain disease or condition.

3. The method of any preceding clause, wherein said amino acid is selected from the group consisting of 996C, 1298F, 1298D, 1299F, 1461T, 1462V, 1464I and 1627K; optionally wherein said disease or condition is a pain disease or condition.

4. The method of any preceding clause, wherein said amino acid is selected from the group consisting of 277X (wherein X is an amino acid other than R), 328X (wherein X is an amino acid other than Y), 395K, 459X (wherein X is an amino acid other than S), 693 X (wherein X is an amino acid other than E), 767X (wherein X is an amino acid other than I), 830X (wherein X is an amino acid other than R), 897X (wherein X is an amino acid other than W), 1200L, 1235L, 1488X (wherein X is an amino acid other than R), 1659X (wherein X is an amino acid other than K) and 1689X (wherein X is an amino acid other than W); optionally wherein said disease or condition is a pain disease or condition.

5. The method of any preceding clause, wherein the constant region gene segment comprised by said human is a germline gene segment.

6. The method of any preceding clause comprising, before said administering, selecting a human comprising said nucleotide sequence of (ii), wherein the human is the human of clause 1.

7. The method of any preceding clause, wherein the human has been determined to comprise the nucleotide sequence that encodes a Nav1.7 protein comprising said amino acid selected from the group consisting of 136I, 216S, 241T, 395K, 848T, 858H, 858F, 863P, 1449V, 996C, 1298F, 1298D, 1299F, 1461T, 1462V, 1464I, 1627K, 277X (wherein X is an amino acid other than R), 328X (wherein X is an amino acid other than Y), 395K, 459X (wherein X is an amino acid other than S), 693 X (wherein X is an amino acid other than E), 767X (wherein X is an amino acid other than I), 830X (wherein X is an amino acid other than R), 897X (wherein X is an amino acid other than W), 1200L, 1235L, 1488X (wherein X is an amino acid other than R), 1659X (wherein X is an amino acid other than K), 1689X (wherein X is an amino acid other than W), 422D, 490N, 943L, 1002L, 1161W and 1919G and/or a Nav1.7 protein comprising said amino acid selected from the group consisting of 136I, 216S, 241T, 395K, 848T, 858H, 858F, 863P, 1449V, 996C, 1298F, 1298D, 1299F, 1461T, 1462V, 1464I, 1627K, 277X (wherein X is an amino acid other than R), 328X (wherein X is an amino acid other than Y), 395K, 459X (wherein X is an amino acid other than S), 693 X (wherein X is an amino acid other than E), 767X (wherein X is an amino acid other than I), 830X (wherein X is an amino acid other than R), 897X (wherein X is an amino acid other than W), 1200L, 1235L, 1488X (wherein X is an amino acid other than R), 1659X (wherein X is an amino acid other than K), 1689X (wherein X is an amino acid other than W), 422D, 490N, 943L, 1002L, 1161W and 1919G.

8. The method of any preceding clause, comprising the step of determining that the human comprises (a) the nucleotide sequence that encodes a Nav1.7 protein comprising said amino acid selected from the group consisting of 136I, 216S, 241T, 395K, 848T, 858H, 858F, 863P, 1449V, 996C, 1298F, 1298D, 1299F, 1461T, 1462V, 1464I, 1627K, 277X (wherein X is an amino acid other than R), 328X (wherein X is an amino acid other than Y), 395K, 459X (wherein X is an amino acid other than S), 693 X (wherein X is an amino acid other than E), 767X (wherein X is an amino acid other than I), 830X (wherein X is an amino acid other than R), 897X (wherein X is an amino acid other than W), 1200L, 1235L, 1488X (wherein X is an amino acid other than R), 1659X (wherein X is an amino acid other than K), 1689X (wherein X is an amino acid other than W), 422D, 490N, 943L, 1002L, 1161W and 1919G and/or (b) a Nav1.7 protein comprising said amino acid selected from the group consisting of 136I, 216S, 241T, 395K, 848T, 858H, 858F, 863P, 1449V, 996C, 1298F, 1298D, 1299F, 1461T, 1462V, 1464I, 1627K, 277X (wherein X is an amino acid other than R), 328X (wherein X is an amino acid other than Y), 395K, 459X (wherein X is an amino acid other than S), 693 X (wherein X is an amino acid other than E), 767X (wherein X is an amino acid other than I), 830X (wherein X is an amino acid other than R), 897X (wherein X is an amino acid other than W), 1200L, 1235L, 1488X (wherein X is an amino acid other than R), 1659X (wherein X is an amino acid other than K), 1689X (wherein X is an amino acid other than W), 422D, 490N, 943L, 1002L, 1161W and 1919G, optionally, wherein the determining step is performed before administration of the antibody to the human.

9. The method of clause 8, wherein the step of determining comprises assaying a biological sample from the human for a nucleotide sequence encoding a Nav1.7 protein comprising said amino acid selected from the group consisting of 136I, 216S, 241T, 395K, 848T, 858H, 858F, 863P, 1449V, 996C, 1298F, 1298D, 1299F, 1461T, 1462V, 1464I, 1627K, 277X (wherein X is an amino acid other than R), 328X (wherein X is an amino acid other than Y), 395K, 459X (wherein X is an amino acid other than S), 693 X (wherein X is an amino acid other than E), 767X (wherein X is an amino acid other than I), 830X (wherein X is an amino acid other than R), 897X (wherein X is an amino acid other than W), 1200L, 1235L, 1488X (wherein X is an amino acid other than R), 1659X (wherein X is an amino acid other than K), 1689X (wherein X is an amino acid other than W), 422D, 490N, 943L, 1002L, 1161W and 1919G.

10. The method of clause 9, wherein the assaying comprises contacting the biological sample with at least one oligonucleotide probe comprising a sequence of at least 10 contiguous nucleotides of a nucleotide sequence encoding a Nav1.7 protein comprising said amino acid selected from the group consisting of 136I, 216S, 241T, 395K, 848T, 858H, 858F, 863P, 1449V, 996C, 1298F, 1298D, 1299F, 1461T, 1462V, 1464I, 1627K, 277X (wherein X is an amino acid other than R), 328X (wherein X is an amino acid other than Y), 395K, 459X (wherein X is an amino acid other than S), 693 X (wherein X is an amino acid other than E), 767X (wherein X is an amino acid other than I), 830X (wherein X is an amino acid other than R), 897X (wherein X is an amino acid other than W), 1200L, 1235L, 1488X (wherein X is an amino acid other than R), 1659X (wherein X is an amino acid other than K), 1689X (wherein X is an amino acid other than W), 422D, 490N, 943L, 1002L, 1161W and 1919G or comprising an antisense sequence of said contiguous nucleotides, wherein said sequence of contiguous nucleotides comprises a nucleotide sequence encoding said amino acid selected from the group consisting of 136I, 216S, 241T, 395K, 848T, 858H, 858F, 863P, 1449V, 996C, 1298F, 1298D, 1299F, 1461T, 1462V, 1464I, 1627K, 277X (wherein X is an amino acid other than R), 328X (wherein X is an amino acid other than Y), 395K, 459X (wherein X is an amino acid other than S), 693 X (wherein X is an amino acid other than E), 767X (wherein X is an amino acid other than I), 830X (wherein X is an amino acid other than R), 897X (wherein X is an amino acid other than W), 1200L, 1235L, 1488X (wherein X is an amino acid other than R), 1659X (wherein X is an amino acid other than K), 1689X (wherein X is an amino acid other than W), 422D, 490N, 943L, 1002L, 1161W and 1919G, thereby forming a complex when at least one nucleotide sequence encoding the Nav1.7 protein comprising said amino acid selected from the group consisting of 136I, 216S, 241T, 395K, 848T, 858H, 858F, 863P, 1449V, 996C, 1298F, 1298D, 1299F, 1461T, 1462V, 1464I, 1627K, 277X (wherein X is an amino acid other than R), 328X (wherein X is an amino acid other than Y), 395K, 459X (wherein X is an amino acid other than S), 693 X (wherein X is an amino acid other than E), 767X (wherein X is an amino acid other than I), 830X (wherein X is an amino acid other than R), 897X (wherein X is an amino acid other than W), 1200L, 1235L, 1488X (wherein X is an amino acid other than R), 1659X (wherein X is an amino acid other than K), 1689X (wherein X is an amino acid other than W), 422D, 490N, 943L, 1002L, 1161W and 1919G is present; and detecting the presence or absence of the complex, wherein detecting the presence of the complex determines that the human comprises the Nav1.7 protein comprising said amino acid selected from the group consisting of 136I, 216S, 241T, 395K, 848T, 858H, 858F, 863P, 1449V, 996C, 1298F, 1298D, 1299F, 1461T, 1462V, 1464I, 1627K, 277X (wherein X is an amino acid other than R), 328X (wherein X is an amino acid other than Y), 395K, 459X (wherein X is an amino acid other than S), 693 X (wherein X is an amino acid other than E), 767X (wherein X is an amino acid other than I), 830X (wherein X is an amino acid other than R), 897X (wherein X is an amino acid other than W), 1200L, 1235L, 1488X (wherein X is an amino acid other than R), 1659X (wherein X is an amino acid other than K), 1689X (wherein X is an amino acid other than W), 422D, 490N, 943L, 1002L, 1161W and 1919G.

11. The method of clause 9, wherein the assaying comprises nucleic acid amplification and optionally one or more methods selected from sequencing, next generation sequencing, nucleic acid hybridization, and allele-specific amplification and/or wherein the assaying is performed in a multiplex format.

12. The method of clause 9 or 11, wherein said biological sample comprises serum, blood, feces, tissue, a cell, urine and/or saliva of said human.

13. The method of any preceding clause, wherein said human is indicated as heterozygous for a nucleotide sequence encoding the Nav1.7 protein comprising said amino acid selected from the group consisting of 136I, 216S, 241T, 395K, 848T, 858H, 858F, 863P, 1449V, 996C, 1298F, 1298D, 1299F, 1461T, 1462V, 1464I, 1627K, 277X (wherein X is an amino acid other than R), 328X (wherein X is an amino acid other than Y), 395K, 459X (wherein X is an amino acid other than S), 693 X (wherein X is an amino acid other than E), 767X (wherein X is an amino acid other than I), 830X (wherein X is an amino acid other than R), 897X (wherein X is an amino acid other than W), 1200L, 1235L, 1488X (wherein X is an amino acid other than R), 1659X (wherein X is an amino acid other than K), 1689X (wherein X is an amino acid other than W), 422D, 490N, 943L, 1002L, 1161W and 1919G, optionally, wherein said human is further indicated as comprising the nucleotide sequence of SEQ ID NO: 76, or said human is indicated as homozygous for a nucleotide sequence encoding the Nav1.7 protein comprising said amino acid selected from the group consisting of 136I, 216S, 241T, 395K, 848T, 858H, 858F, 863P, 1449V, 996C, 1298F, 1298D, 1299F, 1461T, 1462V, 1464I, 1627K, 277X (wherein X is an amino acid other than R), 328X (wherein X is an amino acid other than Y), 395K, 459X (wherein X is an amino acid other than S), 693 X (wherein X is an amino acid other than E), 767X (wherein X is an amino acid other than I), 830X (wherein X is an amino acid other than R), 897X (wherein X is an amino acid other than W), 1200L, 1235L, 1488X (wherein X is an amino acid other than R), 1659X (wherein X is an amino acid other than K), 1689X (wherein X is an amino acid other than W), 422D, 490N, 943L, 1002L, 1161W and 1919G.

14. The method of any preceding clause, wherein said human is or has been further determined to be substantially resistant to a pain or itching treatment.
15. The method of any preceding clause, wherein said human is receiving or has received a pain or itching treatment or has reduced responsiveness to a pain or itching treatment.
16. The method of any preceding clause, wherein said disease or condition is a pain or itching disease or condition.
17. The method of any preceding clause, wherein said disease or condition is a channelopathy or associated with a channelopathy; or is selected from the group consisting of primary erythermalgia (PE), paroxysmal extreme pain disorder (PEPD) and channelopathy-associated insensitivity to pain (CIP).
18. The method of any preceding clause, wherein said human has been diagnosed with at least one condition recited in clause 16 or 17.
19. The method of any preceding clause, wherein said antibody or antibody fragment treats or reduces the risk in said human of a condition recited in clause 16 or 17.
20. The method of any preceding clause, wherein the nucleotide sequence comprises one or more SNPs selected from the group consisting of rs6746030, rs3750904, rs58022607, rs4369876, rs13402180 and rs12478318.
21. The method of any preceding clause, wherein said ligand (eg, antibody or antibody fragment) is administered by inhaled, intravenous or subcutaneous administration and/or is comprised in an inhalable or injectable preparation.
22. The method of any preceding clause, wherein the human gamma-2 heavy chain constant region of the ligand comprises IGHG2*01 amino acid sequence or an ADCC inactivated version thereof.

Ligands with Gamma-2 Constant Region Tailoring

1. A ligand (eg, an antibody or antibody fragment) for use in a method of treating or reducing the risk of a Nav1.7-mediated disease or condition (eg, pain) in a human in need thereof, wherein the ligand specifically binds a huma Nav1.7 protein that comprises an amino acid selected from the group consisting of 136I, 216S, 241T, 395K, 848T, 858H, 858F, 863P, 1449V, 996C, 1298F, 1298D, 1299F, 1461T, 1462V, 1464I, 1627K, 277X (wherein X is an amino acid other than R), 328X (wherein X is an amino acid other than Y), 395K, 459X (wherein X is an amino acid other than S), 693 X (wherein X is an amino acid other than E), 767X (wherein X is an amino acid other than I), 830X (wherein X is an amino acid other than R), 897X (wherein X is an amino acid other than W), 1200L, 1235L, 1488X (wherein X is an amino acid other than R), 1659X (wherein X is an amino acid other than K), 1689X (wherein X is an amino acid other than W), 422D, 490N, 943L, 1002L, 1161W and 1919G;
wherein (i) the ligand comprises a human gamma-2 heavy chain constant region that comprises an amino acid selected from the group consisting of a Pro at position 72 shown in SEQ ID NO: 6, an Asn at position 75 shown in SEQ ID NO: 6, a Phe at position 76 shown in SEQ ID NO: 6, a Val at position 161 shown in SEQ ID NO: 6 and an Ala at position 257 shown in SEQ ID NO: 6 and wherein said human comprises (i) an IGHG2*01 human heavy chain constant region gene segment, or the human expresses antibodies comprising human gamma-2 heavy chain constant regions comprising said selected Pro at position 72 shown in SEQ ID NO: 6, Asn at position 75 shown in SEQ ID NO: 6, Phe at position 76 shown in SEQ ID NO: 6, Val at position 161 shown in SEQ ID NO: 6 or Ala at position 257 shown in SEQ ID NO: 6; and
wherein (ii) said human comprises a nucleotide sequence encoding said Nav1.7 protein comprising said amino acid selected from the group consisting of 136I, 216S, 241T, 395K, 848T, 858H, 858F, 863P, 1449V, 996C, 1298F, 1298D, 1299F, 1461T, 1462V, 1464I, 1627K, 277X (wherein X is an amino acid other than R), 328X (wherein X is an amino acid other than Y), 395K, 459X (wherein X is an amino acid other than S), 693 X (wherein X is an amino acid other than E), 767X (wherein X is an amino acid other than I), 830X (wherein X is an amino acid other than R), 897X (wherein X is an amino acid other than W), 1200L, 1235L, 1488X (wherein X is an amino acid other than R), 1659X (wherein X is an amino acid other than K), 1689X (wherein X is an amino acid other than W), 422D, 490N, 943L, 1002L, 1161W and 1919G.

In an alternative, paragraph 1 provides:—

A ligand (eg, an antibody or antibody fragment) for use in a method of targeting Nav1.7 in a human, wherein the ligand specifically binds a huma Nav1.7 protein that comprises an amino acid selected from the group consisting of 136I, 216S, 241T, 395K, 848T, 858H, 858F, 863P, 1449V, 996C, 1298F, 1298D, 1299F, 1461T, 1462V, 1464I, 1627K, 277X (wherein X is an amino acid other than R), 328X (wherein X is an amino acid other than Y), 395K, 459X (wherein X is an amino acid other than S), 693 X (wherein X is an amino acid other than E), 767X (wherein X is an amino acid other than I), 830X (wherein X is an amino acid other than R), 897X (wherein X is an amino acid other than W), 1200L, 1235L, 1488X (wherein X is an amino acid other than R), 1659X (wherein X is an amino acid other than K), 1689X (wherein X is an amino acid other than W), 422D, 490N, 943L, 1002L, 1161W and 1919G;
wherein (i) the ligand comprises a human gamma-2 heavy chain constant region that comprises an amino acid selected from the group consisting of a Pro at position 72 shown in SEQ ID NO: 6, an Asn at position 75 shown in SEQ ID NO: 6, a Phe at position 76 shown in SEQ ID NO: 6, a Val at position 161 shown in SEQ ID NO: 6 and an Ala at position 257 shown in SEQ ID NO: 6 and wherein said human comprises (i) an IGHG2*01 human heavy chain constant region gene segment, or the human expresses antibodies comprising human gamma-2 heavy chain constant regions comprising said selected Pro at position 72 shown in SEQ ID NO: 6, Asn at position 75 shown in SEQ ID NO: 6, Phe at position 76 shown in SEQ ID NO: 6, Val at position 161 shown in SEQ ID NO: 6 or Ala at position 257 shown in SEQ ID NO: 6; and
wherein (ii) said human comprises a nucleotide sequence encoding said Nav1.7 protein comprising said amino acid selected from the group consisting of 136I, 216S, 241T, 395K, 848T, 858H, 858F, 863P, 1449V, 996C, 1298F, 1298D, 1299F, 1461T, 1462V, 1464I, 1627K, 277X (wherein X is an amino acid other than R), 328X (wherein X is an amino acid other than Y), 395K, 459X (wherein X is an amino acid other than S), 693 X (wherein X is an amino acid other than E), 767X (wherein X is an amino acid other than I), 830X (wherein X is an amino acid other than R), 897X (wherein X is an amino acid other than W), 1200L, 1235L, 1488X (wherein X is an amino acid other than R), 1659X (wherein X is an amino acid other than K), 1689X (wherein X is an amino acid other than W), 422D, 490N, 943L, 1002L, 1161W and 1919G.

In an example, the human is suffering from or at risk of a Nav1.7-mediated disease or condition.
In an example, the method treats or reduces the risk of a Nav1.7-mediated disease or condition in the human.

2. The ligand of any preceding clause, wherein said amino acid is selected from the group consisting of any one of 136I, 216S, 241T, 395K, 848T, 858H, 858F, 863P and 1449V; optionally wherein said disease or condition is a pain disease or condition.
3. The ligand of any preceding clause, wherein said amino acid is selected from the group consisting of 996C, 1298F, 1298D, 1299F, 1461T, 1462V, 1464I and 1627K; optionally wherein said disease or condition is a pain disease or condition.
4. The ligand of any preceding clause, wherein said amino acid is selected from the group consisting of 277X (wherein X is an amino acid other than R), 328X (wherein X is an amino acid other than Y), 395K, 459X (wherein X is an amino acid other than S), 693 X (wherein X is an amino acid other than E), 767X (wherein X is an amino acid other than I), 830X (wherein X is an amino acid other than R), 897X (wherein X is an amino acid other than W), 1200L, 1235L, 1488X (wherein X is an amino acid other than R), 1659X (wherein X is an amino acid other than K) and 1689X (wherein X is an amino acid other than W); optionally wherein said disease or condition is a pain disease or condition.
5. The ligand of any preceding clause, wherein the VH gene segment comprised by said human is a germline VH gene segment.
6. The ligand of any preceding clause said method comprising, before said administering, selecting a human comprising said nucleotide sequence of (ii), wherein the human is the human of clause 1.
7. The ligand of any preceding clause, wherein the human has been determined to comprise the nucleotide sequence that encodes a Nav1.7 protein comprising said amino acid selected from the group consisting of 136I, 216S, 241T, 395K, 848T, 858H, 858F, 863P, 1449V, 996C, 1298F, 1298D, 1299F, 1461T, 1462V, 1464I, 1627K, 277X (wherein X is an amino acid other than R), 328X (wherein X is an amino acid other than Y), 395K, 459X (wherein X is an amino acid other than S), 693 X (wherein X is an amino acid other than E), 767X (wherein X is an amino acid other than I), 830X (wherein X is an amino acid other than R), 897X (wherein X is an amino acid other than W), 1200L, 1235L, 1488X (wherein X is an amino acid other than R), 1659X (wherein X is an amino acid other than K), 1689X (wherein X is an amino acid other than W), 422D, 490N, 943L, 1002L, 1161W and 1919G and/or a Nav1.7 protein comprising said amino acid selected from the group consisting of 136I, 216S, 241T, 395K, 848T, 858H, 858F, 863P, 1449V, 996C, 1298F, 1298D, 1299F, 1461T, 1462V, 1464I, 1627K, 277X (wherein X is an amino acid other than R), 328X (wherein X is an amino acid other than Y), 395K, 459X (wherein X is an amino acid other than S), 693 X (wherein X is an amino acid other than E), 767X (wherein X is an amino acid other than I), 830X (wherein X is an amino acid other than R), 897X (wherein X is an amino acid other than W), 1200L, 1235L, 1488X (wherein X is an amino acid other than R), 1659X (wherein X is an amino acid other than K), 1689X (wherein X is an amino acid other than W), 422D, 490N, 943L, 1002L, 1161W and 1919G.
8. The ligand of any preceding clause, said method comprising the step of determining that the human comprises (a) the nucleotide sequence that encodes a Nav1.7 protein comprising said amino acid selected from the group consisting of 136I, 216S, 241T, 395K, 848T, 858H, 858F, 863P, 1449V, 996C, 1298F, 1298D, 1299F, 1461T, 1462V, 1464I, 1627K, 277X (wherein X is an amino acid other than R), 328X (wherein X is an amino acid other than Y), 395K, 459X (wherein X is an amino acid other than S), 693 X (wherein X is an amino acid other than E), 767X (wherein X is an amino acid other than I), 830X (wherein X is an amino acid other than R), 897X (wherein X is an amino acid other than W), 1200L, 1235L, 1488X (wherein X is an amino acid other than R), 1659X (wherein X is an amino acid other than K), 1689X (wherein X is an amino acid other than W), 422D, 490N, 943L, 1002L, 1161W and 1919G and/or (b) a Nav1.7 protein comprising said amino acid selected from the group consisting of 136I, 216S, 241T, 395K, 848T, 858H, 858F, 863P, 1449V, 996C, 1298F, 1298D, 1299F, 1461T, 1462V, 1464I, 1627K, 277X (wherein X is an amino acid other than R), 328X (wherein X is an amino acid other than Y), 395K, 459X (wherein X is an amino acid other than S), 693 X (wherein X is an amino acid other than E), 767X (wherein X is an amino acid other than I), 830X (wherein X is an amino acid other than R), 897X (wherein X is an amino acid other than W), 1200L, 1235L, 1488X (wherein X is an amino acid other than R), 1659X (wherein X is an amino acid other than K), 1689X (wherein X is an amino acid other than W), 422D, 490N, 943L, 1002L, 1161W and 1919G, optionally, wherein the determining step is performed before administration of the antibody to the human.
9. The ligand of clause 8, wherein the step of determining comprises assaying a biological sample from the human for a nucleotide sequence encoding a Nav1.7 protein comprising said amino acid selected from the group consisting of 136I, 216S, 241T, 395K, 848T, 858H, 858F, 863P, 1449V, 996C, 1298F, 1298D, 1299F, 1461T, 1462V, 1464I, 1627K, 277X (wherein X is an amino acid other than R), 328X (wherein X is an amino acid other than Y), 395K, 459X (wherein X is an amino acid other than S), 693 X (wherein X is an amino acid other than E), 767X (wherein X is an amino acid other than I), 830X (wherein X is an amino acid other than R), 897X (wherein X is an amino acid other than W), 1200L, 1235L, 1488X (wherein X is an amino acid other than R), 1659X (wherein X is an amino acid other than K), 1689X (wherein X is an amino acid other than W), 422D, 490N, 943L, 1002L, 1161W and 1919G.
10. The ligand of clause 9, wherein the assaying comprises contacting the biological sample with at least one oligonucleotide probe comprising a sequence of at least 10 contiguous nucleotides of a nucleotide sequence encoding a Nav1.7 protein comprising said amino acid selected from the group consisting of 136I, 216S, 241T, 395K, 848T, 858H, 858F, 863P, 1449V, 996C, 1298F, 1298D, 1299F, 1461T, 1462V, 1464I, 1627K, 277X (wherein X is an amino acid other than R), 328X (wherein X is an amino acid other than Y), 395K, 459X (wherein X is an amino acid other than S), 693 X (wherein X is an amino acid other than E), 767X (wherein X is an amino acid other than I), 830X (wherein X is an amino acid other than R), 897X (wherein X is an amino acid other than W), 1200L, 1235L, 1488X (wherein X is an amino acid other than R), 1659X (wherein X is an amino acid other than K), 1689X (wherein X is an amino acid other than W), 422D, 490N, 943L, 1002L, 1161W and 1919G or comprising an antisense sequence of said contiguous nucleotides, wherein said sequence of contiguous nucleotides comprises a nucleotide sequence encoding said amino acid selected from the group consisting of 136I, 216S, 241T, 395K, 848T, 858H, 858F, 863P, 1449V, 996C, 1298F, 1298D, 1299F, 1461T, 1462V, 1464I, 1627K, 277X (wherein X is an amino acid other than R), 328X (wherein X is an amino acid other than Y), 395K, 459X (wherein X is an amino acid other than S), 693 X (wherein X is an amino acid other than E), 767X (wherein X is an amino acid other than I), 830X (wherein X is an amino acid other than R), 897X (wherein X is an amino acid other than W), 1200L, 1235L, 1488X (wherein X is an amino acid other than R), 1659X (wherein X is an amino acid other than K), 1689X (wherein X is an amino acid other than W), 422D, 490N, 943L, 1002L, 1161W and 1919G, thereby forming a complex when at least one nucleotide sequence encoding the Nav1.7 protein comprising said amino acid selected from the group consisting of 136I, 216S, 241T, 395K, 848T, 858H, 858F, 863P, 1449V, 996C, 1298F, 1298D, 1299F, 1461T, 1462V, 1464I, 1627K, 277X (wherein X is an amino acid other than R), 328X (wherein X is an amino acid other than Y), 395K, 459X (wherein X is an amino acid other than S), 693 X (wherein X is an amino acid other than E), 767X (wherein X is an amino acid other than I), 830X (wherein X is an amino acid other than R), 897X (wherein X is an amino acid other than W), 1200L, 1235L, 1488X (wherein X is an amino acid other than R), 1659X (wherein X is an amino acid other than K), 1689X (wherein X is an amino acid other than W), 422D, 490N, 943L, 1002L, 1161W and 1919G is present; and detecting the presence or absence of the complex, wherein detecting the presence of the complex determines that the human comprises the Nav1.7 protein comprising said amino acid selected from the group consisting of 136I, 216S, 241T, 395K, 848T, 858H, 858F, 863P, 1449V, 996C, 1298F, 1298D, 1299F, 1461T, 1462V, 1464I, 1627K, 277X (wherein X is an amino acid other than R), 328X (wherein X is an amino acid other than Y), 395K, 459X (wherein X is an amino acid other than S), 693 X (wherein X is an amino acid other than E), 767X (wherein X is an amino acid other than I), 830X (wherein X is an amino acid other than R), 897X (wherein X is an amino acid other than W), 1200L, 1235L, 1488X (wherein X is an amino acid other than R), 1659X (wherein X is an amino acid other than K), 1689X (wherein X is an amino acid other than W), 422D, 490N, 943L, 1002L, 1161W and 1919G.

11. The ligand of clause 9, wherein the assaying comprises nucleic acid amplification and optionally one or more methods selected from sequencing, next generation sequencing, nucleic acid hybridization, and allele-specific amplification and/or wherein the assaying is performed in a multiplex format.

12. The ligand of clause 9 or 11, wherein said biological sample comprises serum, blood, feces, tissue, a cell, urine and/or saliva of said human.

13. The ligand of any preceding clause, wherein said human is indicated as heterozygous for a nucleotide sequence encoding the Nav1.7 protein comprising said amino acid selected from the group consisting of 136I, 216S, 241T, 395K, 848T, 858H, 858F, 863P, 1449V, 996C, 1298F, 1298D, 1299F, 1461T, 1462V, 1464I, 1627K, 277X (wherein X is an amino acid other than R), 328X (wherein X is an amino acid other than Y), 395K, 459X (wherein X is an amino acid other than S), 693 X (wherein X is an amino acid other than E), 767X (wherein X is an amino acid other than I), 830X (wherein X is an amino acid other than R), 897X (wherein X is an amino acid other than W), 1200L, 1235L, 1488X (wherein X is an amino acid other than R), 1659X (wherein X is an amino acid other than K), 1689X (wherein X is an amino acid other than W), 422D, 490N, 943L, 1002L, 1161W and 1919G, optionally, wherein said human is further indicated as comprising the nucleotide sequence of SEQ ID NO: 76, or said human is indicated as homozygous for a nucleotide sequence encoding the Nav1.7 protein comprising said amino acid selected from the group consisting of 136I, 216S, 241T, 395K, 848T, 858H, 858F, 863P, 1449V, 996C, 1298F, 1298D, 1299F, 1461T, 1462V, 1464I, 1627K, 277X (wherein X is an amino acid other than R), 328X (wherein X is an amino acid other than Y), 395K, 459X (wherein X is an amino acid other than S), 693 X (wherein X is an amino acid other than E), 767X (wherein X is an amino acid other than I), 830X (wherein X is an amino acid other than R), 897X (wherein X is an amino acid other than W), 1200L, 1235L, 1488X (wherein X is an amino acid other than R), 1659X (wherein X is an amino acid other than K), 1689X (wherein X is an amino acid other than W), 422D, 490N, 943L, 1002L, 1161W and 1919G.

14. The ligand of any preceding clause, wherein said human is or has been further determined to be substantially resistant to a pain or itching treatment.

15. The ligand of any preceding clause, wherein said human is receiving or has received a pain or itching treatment or has reduced responsiveness to a pain or itching treatment.

16. The ligand of any preceding clause, wherein said disease or condition is a pain or itching disease or condition.

17. The ligand of any preceding clause, wherein said disease or condition is a channelopathy or associated with a channelopathy; or is selected from the group consisting of primary erythermalgia (PE), paroxysmal extreme pain disorder (PEPD) and channelopathy-associated insensitivity to pain (CIP).

18. The ligand of any preceding clause, wherein said human has been diagnosed with at least one condition recited in clause 16 or 17.

19. The ligand of any preceding clause, wherein said antibody or antibody fragment treats or reduces the risk in said human of a condition recited in clause 16 or 17.

20. The ligand of any preceding clause, wherein the nucleotide sequence comprises one or more SNPs selected from the group consisting of rs6746030, rs3750904, rs58022607, rs4369876, rs13402180 and rs12478318.

21. The ligand of any preceding clause, wherein said ligand (eg, antibody or antibody fragment) is for inhaled, intravenous or subcutaneous administration and/or is comprised in an inhalable or injectable preparation.

22. The ligand of any preceding clause, wherein the human gamma-2 heavy chain constant region of the ligand comprises IGHG2*01 amino acid sequence or an ADCC inactivated version thereof.

TABLE 4

1000 GENOMES PROJECT HUMAN POPULATIONS
Below is a summary of the ethnic populations as per the 1000 Genomes Project sequences.

Population

European ancestry

Utah residents (CEPH) with Northern and Western European ancestry (CEU)
Toscani in Italia (TSI)
British from England and Scotland (GBR)
Finnish from Finland (FIN)
Iberian populations in Spain (IBS)

TABLE 4-continued

1000 GENOMES PROJECT HUMAN POPULATIONS
Below is a summary of the ethnic populations as per the
1000 Genomes Project sequences.
Population

East Asian ancestry

Han Chinese in Beijing, China (CHB)
Japanese in Toyko, Japan (JPT)
Han Chinese South (CHS)
Chinese Dai in Xishuangbanna (CDX)
Kinh in Ho Chi Minh City, Vietnam (KHV)
Chinese in Denver, Colorado (CHD) (pilot 3 only)

West African ancestry

Yoruba in Ibadan, Nigeria (YRI)
Luhya in Webuye, Kenya (LWK)
Gambian in Western Division, The Gambia (GWD)
Malawian in Blantyre, Malawi (MAB)
West African Population (TBD)

TABLE 4-continued

1000 GENOMES PROJECT HUMAN POPULATIONS
Below is a summary of the ethnic populations as per the
1000 Genomes Project sequences.
Population

Americas

African Ancestry in Southwest US (ASW)
African American in Jackson, MS (AJM)
African Caribbean in Barbados (ACB)
Mexican Ancestry in Los Angeles, CA (MXL)
Puerto Rican in Puerto Rico (PUR)
Colombian in Medellin, Colombia (CLM)
Peruvian in Lima, Peru (PEL)

South Asian ancestry

Ahom in the State of Assam, India
Kayadtha in Calcutta, India
Reddy in Hyderabad, India
Maratha in Bombay, India
Punjabi in Lahore, Pakistan

TABLE 5

TOIs & Related Diseases, Conditions and Example Ligands

| Human TOI | Example Disease or Condition | Example Ligand |
| --- | --- | --- |
| Il-17a | Inflammatory Disease<br>Uveitis<br>Rheumatoid Arthritis<br>Psoriasis | AIN457<br>Ixekizumab |
| Angiotensin II Receptor Type 1 ($AT_1$) | Hypertension | LCZ696 |
| Neprilysin | Hypertension | LCZ696 |
| Metabotropic Glutamate Receptor 5 (Mglur5) | Fragile X Syndrome | AFQ056<br>Mavoglurant |
| A Histone Deacetylase | Cancer, Eg, Multiple Myeloma | LBH589<br>Panobinostat |
| Diacylglycerol acyltransferase-1 (DGAT-1) | Familial Chylomicronaemia Syndrome | LCQ908<br>Pradigastat |
| Smoothened (Smo) | Basal cell carcinoma<br>Solid tumour<br>Myelofibrosis<br>Medulloblastoma<br>Solid tumour | LDE225 |
| Smoothened (Smo) receptor | Basal cell carcinoma<br>Solid tumors | LEQ506 |
| ALK | Non small cell lung carcinoma (NSCLC) | LDK378 |
| phosphatidylinositol-3-kinase (PI3K)<br>mTOR<br>AKT | Cancer, eg, solid tumour, breast cancer, Renal cell carcinoma (RCC), Endometrial cancer, Non-small cell lung cancer (NSCLC), prostate cancer, Glioblastoma multiforme (GBM)<br>CRPC<br>GIST<br>Myelofibrosis | BKM120 |
| mTOR<br>PI3K<br>AKT | Cancer, eg, solid tumour, breast cancer, Renal cell carcinoma (RCC), Endometrial cancer, Non-small cell lung cancer (NSCLC), prostate cancer, Glioblastoma multiforme (GBM)<br>CRPC<br>GIST<br>Myelofibrosis | BEZ235 |
| PI3Kα<br>mTOR<br>PI3K<br>AKT | Cancer, eg, solid tumour, breast cancer, Renal cell carcinoma (RCC), Endometrial cancer, Non-small cell lung cancer | BYL719 |

TABLE 5-continued

TOIs & Related Diseases, Conditions and Example Ligands

| Human TOI | Example Disease or Condition | Example Ligand |
|---|---|---|
| | (NSCLC), prostate cancer, Glioblastoma multiforme (GBM) CRPC GIST Myelofibrosis | |
| Mitogen-activated ERK kinase 1 (MEK1) Mitogen-activated ERK kinase 2 (MEK2) | Cancer, eg, solid tumour, melanoma, pancreatic, colon, lung or thyroid cancer Metastasis | MEK162 |
| protein kinase protein kinase C FLT-3 c-KIT | Acute myeloid leukemia (AML) Myelodysplastic syndrome (MDS) Aggressive systemic mastocytosis (ASM) | PKC412 Midostaurin |
| ActRIIB | Sporadic inclusion body myositis (sIBM) | BYM338 bimagrumab |
| CD19 | Cancer, eg, Leukaemia, mast cell leukemia, Acute Lymphoblastic Leukemia, Chronic lymphocytic leukemia (CLL) or Hematological tumors | CTL019 (formerly CART-19) |
| 11β-hydroxylase | Cushing's syndrome | LCI699 |
| BRAF | Cancer, eg, melanoma | LGX818 |
| Receptor Tyrosine Kinase FGFR | Cancer, eg, solid tumour Breast Cancer Endometrial cancer Hepatocellular carcinoma Renal cell carcinoma (RCC) Bladder cancer multiple myeloma (MM), hepatocellular carcinoma endometrial cancer | TKI258 (formerly CHIR-258) Dovitinib |
| DAC enzyme | hematologic malignancy Multiple myeloma Myel\odysplastic syndrome (MDS) Myelofibrosis | LBH589 panobinostat |
| HSP90 | Cancer, eg, Breast Cancer, gastric cancer or Non-small cell lung cancer (NSCLC) | AUY922 |
| FGFR | Cancer, eg, solid tumour Breast Cancer Endometrial cancer Hepatocellular carcinoma Renal cell carcinoma (RCC) Bladder cancer multiple myeloma (MM), hepatocellular carcinoma endometrial cancer | BGJ398 |
| cIAP1 cIAP2 | Cancer, eg, solid tumour Breast Cancer Endometrial cancer Hepatocellular carcinoma | LCL161 |

TABLE 5-continued

TOIs & Related Diseases, Conditions and Example Ligands

| Human TOI | Example Disease or Condition | Example Ligand |
|---|---|---|
| | Renal cell carcinoma (RCC) Bladder cancer multiple myeloma (MM), hepatocellular carcinoma endometrial cancer | |
| Akt | Cancer, eg, Solid tumour, gastric cancer (eg, castration-resistant prostate cancer), prostate cancer, gastroesophageal junction cancer | GDC-0068 RG7440 |
| CD22 | Hematologic malignancies Non-Hodgkin's lymphoma (eg, relapsed or refractory follicular non-Hodgkin's lymphoma) Diffuse large B-cell lymphoma (eg, relapsed or refractory diffuse large B-cell lymphoma) | DCDT2980S RG7593 |
| CD79b | Hematologic malignancies Non-Hodgkin's lymphoma (eg, relapsed or refractory follicular non-Hodgkin's lymphoma) Diffuse large B-cell lymphoma (eg, relapsed or refractory diffuse large B-cell lymphoma) | DCDS4501A RG7596 |
| endothelin B receptor (ETBR) | Melanoma, eg, metastatic or unresectable melanoma | DEDN6526A RG7636 |
| HER3 | Cancer, eg, metastatic epithelial tumour, metastatic squamous cell carcinoma of the head and neck cancer, metastatic colorectal cancer | MEHD7945A RG7597 |
| EGFR | Cancer, eg, metastatic epithelial tumour, metastatic squamous cell carcinoma of the head and neck cancer, metastatic colorectal cancer | MEHD7945A RG7597 Necitumumab |
| MUC16 | Cancer, eg, ovarian cancer (eg, platinum-resistant ovarian cancer) | DMUC5754A RG7458 |
| sodium-dependent phosphate transport protein 2b (NaPi2b) | Cancer, eg, metastatic non-squamous non-small cell lung cancer, ovarian cancer (eg, platinum-resistant ovarian cancer) | DNIB0600A RG7599 |
| PDL1 (programmed death ligand 1) | Cancer, eg, solid tumour metastatic melanoma non-small cell lung cancer | MPDL3280A RG7446 |
| STEAP1 (six-transmembrane epithelial antigen of the prostate 1) | Cancer, eg, prostate cancer (eg, metastatic castration-resistant prostate cancer) | DSTP3086S RG7450 |
| Bcl-2 | Cancer, eg, leukaemia (eg, chronic lymphocytic leukaemia), non-Hodgkin's lymphoma | GDC-0199 RG7601 |
| Checkpoint kinase 1 (ChK1) | Cancer, eg, solid tumour, refractory solid tumour or lymphoma | GDC-0425 RG7602 GDC-0575 RG7741 |
| mitogen activated protein kinase kinase (MAPKK) MEK | Cancer, eg, solid tumour, melanoma (eg, metastatic melanoma) | GDC-0973 RG7421 Cobimetinib GDC-0623 RG7420 |

TABLE 5-continued

TOIs & Related Diseases, Conditions and Example Ligands

| Human TOI | Example Disease or Condition | Example Ligand |
|---|---|---|
| epidermal growth factor domain-like-7 (EGFL7) | Cancer, eg, colorectal cancer (eg, metastatic colorectal cancer), NSCLC | Parsatuzumab MEGF0444A RG7414 |
| phosphatidylinositol-3-kinase (PI3K) | Cancer, eg, prostate cancer, renal cell carcinoma, endometrial cancer, breast cancer (eg, HER2-negative metastatic breast cancer, metastatic hormone receptor-positive breast cancer), solid tumour | GDC-0032 RG7604 GDC-0084 RG7666 Pictilisib GDC-0941 RG7321 |
| mTOR TORC1 TORC2 PI3K | Cancer, eg, prostate cancer, renal cell carcinoma, endometrial cancer, breast cancer (eg, HER2-negative metastatic breast cancer, metastatic hormone receptor-positive breast cancer), solid tumour | GDC-0980 RG7422 |
| IL17 | Autoimmune disease Ankylosing spondylitis; Asthma; Multiple myeloma; Multiple sclerosis; Polymyalgia rheumatica; Psoriasis; Psoriatic arthritis; Rheumatoid arthritis; Uveitis | Secukinumab ixekizumab |
| M1 prime segment of membrane IgE | Allergic Asthma | Quilizumab MEMP1972A RG7449 |
| IFN alpha | Autoimmune disease Systemic lupus erythematosus | Rontalizumab |
| PCSK9 (proprotein convertase subtilisin/kexin type 9) | coronary heart disease (CHD) or high risk of CHD hyperlipidaemia hypercholesterolaemia stroke atherosclerosis a cardiovascular disease or condition a condition associated with elevated LDL | MPSK3169A RG7652 |
| Vascular Endothelial Growth Factor-A (VEGF-A) Placental Growth Factor (PlGF) | Diabetic Macular Edema (DME), Branch Retinal Vein Occlusion (BRVO) Wet age-related macular degeneration (Wet AMD) | EYLEA® Aflibercept AVASTIN™ LUCENTIS™ |
| IL-6 receptor | Inflammatory disease, eg, rheumatoid arthritis Uveitis (eg, non-infectious uveitis) Ankylosing spondylitis; Cancer | Sarilumab REGN88 |
| PCSK9 (proprotein convertase subtilisin/kexin type 9) | coronary heart disease (CHD) or high risk of CHD hyperlipidaemia hypercholesterolaemia stroke atherosclerosis a cardiovascular disease or condition a condition associated with elevated LDL | Alirocumab REGN727 LY3015014 |
| NGF | Osteoarthritis Pain | Fasinumab REGN475 |
| IL-4 receptor alpha IL-13 receptor | Allergic asthma eosinophilic asthma Atopic dermatitis | Dupilumab REGN668 |
| delta-like ligand-4 (Dll4) | Cancer | Enoticumab REGN421 |
| angiopoietin-2 (Ang2) | Cancer | Nesvacumab REGN910 |

TABLE 5-continued

TOIs & Related Diseases, Conditions and Example Ligands

| Human TOI | Example Disease or Condition | Example Ligand |
|---|---|---|
| GDF8 | Metabolic disorder cancer, obesity, diabetes, arthritis, multiple sclerosis, muscular dystrophy, amyotrophic lateral sclerosis, Parkinson's disease, osteoporosis, osteoarthritis, osteopenia, metabolic syndromes (including, but not limited to diabetes, obesity, nutritional disorders, organ atrophy, chronic obstructive pulmonary disease and anorexia) Disuse muscle atrophy cancer-related cachexia | REGN1033 LY2495655 |
| ERBB3 | Cancer | REGN1400 |
| angiopoietin-1 (Ang1) angiopoietin-1 (Ang2) | Cancer, eg, ovarian cancer | AMG386 |
| VEGF receptor PDGF receptor Stem cell factor receptor | Cancer NSCLC Breast cancer Thyroid cancer | Motesanib AMG 706 |
| type 1 insulin-like growth factor receptor (IGF1R) | Cancer Breast cancer Pancreatic cancer | Ganitumab Linsitinib ASP7487 |
| hepatocyte growth factor (HGF) | Cancer Breast cancer Pancreatic cancer | Rilotumumab |
| HER3 ErbB3 | Cancer Breast cancer Pancreatic cancer | AMG 888 U3-1287 |
| IL-17 receptor | Inflammatory disease Asthma Psoriasis | AMG 827 brodalumab |
| sclerostin | Bone-related condition postmenopausal osteoporosis fracture healing | AMG 785 CDP7851 |
| glucokinase | Diabetes | AMG 151 ARRY-403 |
| PCSK9 (proprotein convertase subtilisin/kexin type 9) | coronary heart disease (CHD) or high risk of CHD hyperlipidaemia hypercholesterolaemia stroke atherosclerosis a cardiovascular disease or condition a condition associated with elevated LDL | AMG 145 Evolocumab |
| VLA 2 Integrin α2β1 | Inflammatory bowel disease | SAR339658 |
| IL-4 IL-13 | Idiopathic pulmonary fibrosis | SAR156597 |
| lysophosphatidic acid receptor LPA-1 LPA-3 | Systemic sclerosis fibrosis | SAR100842 |
| Androgen receptor | Cancer, eg, prostate cancer, breast cancer | MDV3100 enzalutamide |
| HER1 EGFR | Cancer, eg, NSCLC | Erlotinib ERBITUX™ VECTIBIX™ |
| VEGF receptor 1 VEGF receptor 2 VEGF receptor 3 | Cancer, eg, colorectal cancer, breast cancer | ASP4130 tivozanib |
| JAK JAK1 JAK2 | Inflammatory disease, eg, rheumatoid arthritis Diabetic nephropathy | ASP015K Baricitinib |
| CD40 | Prevention of organ transplant rejection | ASP1240 |
| GnRH | Endometriosis Cancer, eg, prostate cancer | ASP1707 degarelix |

TABLE 5-continued

TOIs & Related Diseases, Conditions and Example Ligands

| Human TOI | Example Disease or Condition | Example Ligand |
|---|---|---|
| PDE9 | Lower unirary tract symptoms associated with benign prostatic hyperplasia | ASP4901 |
| TNF alpha | Inflammatory disease, eg, rheumatoid arthritis, psoriasis, chrohn's disease, IBD | Certolizumab pegol |
| Programmed cell death protein 1 | Cancer Chronic myelocytic leukemia; Hepatitis C virus infection; Hepatocellular carcinoma; Hodgkins disease; Melanoma; Multiple myeloma; Non-Hodgkin lymphoma; Non-small-cell lung cancer; Renal cell carcinoma; Solid tumor; Stage IV melanoma | Nivolumab MK-3475 |
| Hepatocyte growth factor MET | Cancer Glioblastoma; Hepatocellular carcinoma; Metastatic colorectal cancer; Metastatic non small cell lung cancer; Metastatic stomach cancer; Non-small-cell lung cancer | onartuzumab |
| Angiopoietin ligand-1 Angiopoietin ligand-2 Tek tyrosine kinase receptor | Breast tumor; Cancer; Colorectal tumor; Fallopian tube cancer; Gastrointestinal tumor; Glioblastoma; Hepatocellular carcinoma; Metastatic esophageal cancer; Metastatic gastrointestinal cancer; Metastatic non small cell lung cancer; Metastatic ovary cancer; Metastatic renal cancer; Ovary tumor; Peritoneal tumor; Transitional cell carcinoma | trebananib |
| CD37 modulator Lymphocyte function antigen-3 receptor SLAM family member 7 | Cancer Multiple myeloma | elotuzumab |
| IL-2 IL-2 receptor alpha | Multiple sclerosis | daclizumab |
| EGFR | Cancer Metastatic non small cell lung cancer; Solid tumor | necitumumab |
| IL-5 | Asthma; Eosinophilic esophagitis | reslizumab |
| B-lymphocyte cell adhesion molecule CD22 | Cancer, eg Acute lymphoblastic leukemia; Follicle center lymphoma; Non-Hodgkin lymphoma; Systemic lupus erythematosus, hairy cell leukaemia | Inotuzumab inotuzumab ozogamicin epratuzumab moxetumomab moxetumomab pasudotox |
| IL1 beta | Acne vulgaris; Atherosclerosis; Behcets disease; Cardiovascular disease; Dermatomyositis; Insulin dependent diabetes; Multiple myeloma; Osteoarthritis; Paraproteinemia; Polymyositis; Pyoderma gangrenosum; Scleritis; Uveitis | gevokizumab |
| CD20 | Cancer Multiple sclerosis follicular lymphoma (eg, refractory or relapsed) | Ocrelizumab ofatumumab |

TABLE 5-continued

TOIs & Related Diseases, Conditions and Example Ligands

| Human TOI | Example Disease or Condition | Example Ligand |
|---|---|---|
| | diffuse large B cell lymphoma (eg, relapsed) chronic lymphocytic leukaemia (eg, first line therapy or relapsed) | |
| IL-23 | Crohns disease; Inflammatory disease; Psoriasis | tildrakizumab |
| BAFF Neutrokine alpha | Autoimmune disease systemic lupus erythematosus Multiple myeloma vasculitis | Belimumab Benlysta™ Tabalumab |
| IL5 | Asthma | mepolizumab |
| IL6 | Inflammatory disease rheumatoid arthritis | sirukumab |
| Lp-PLA2 | Atherosclerosis diabetic macular oedema | darapladib |
| CCR9 chemokine receptor | Inflammatory disease rheumatoid arthritis Crohn's disease | Vercirnon |
| DOPA decarboxylase | Parkinson's Disease | Patrome |
| Her2 | Cancer, eg, gastric cancer, breast cancer, head and neck squamous cell cancer, | Tyverb™ Tykerb™ |
| EGFR | | lapatinib |
| ADP receptor | Cardiovascular disease or condition Thrombosis, eg, arterial thrombosis | Brilinta Brilique |
| VEGFR EGFR | Cancer, eg, medullary thyroid cancer | Caprelsa |
| LABA LAMA | Respiratory disease or condition, eg, COPD | PT003 GFF |
| Factor Xa | thromboembolism | apixaban |
| Oxelumab | OX40 ligand | Asthma Graft-versus-host disease |
| Tremelimumab Ticilimumab ipilimumab | CTLA-4 CD152 | Cancer, eg, melanoma Autoimmune disease |
| MPDL3280A MEDI4736 | PD-L1 | Cancer, eg, solid tumour, kidney cancer, lung cancer, melanoma, NSCLC, multiple myeloma Autoimmune disease |
| Nivolumab AMP-514 AMP-224 | PD-1 LIGHT TNF SF 14 CD40 ligand | Cancer, eg, solid tumour, kidney cancer, lung cancer, melanoma, NSCLC, multiple myeloma Autoimmune disease |
| JAK | Inflammatory disease, eg, rheumatoid arthritis, psoriasis, chrohn's disease, IBD, ulcerative colitis, Psoriatic Arthritis | tofacitinib |
| Nerve Growth Factor | Pain Osteoarthritis pain | tanezumab |
| Her1 receptor Her2 receptor Her4 receptor | Cancer, eg, Non-Small Cell Lung Cancer | dacomitinib |
| c-MET ALK | Cancer, eg, Non-Small Cell Lung Cancer | crizotinib |
| Programmed cell death 1 receptor | Cancer, eg, renal cell carcinoma | Nivolumab |
| SLAMF7 CD319 | Cancer, eg, multiple myeloma | Elotuzumab |
| CD30 | Cancer, eg, Hodgkin lymphoma, systemic anaplastic large cell lymphoma, T-cell lymphoma | Brentuximab Brentuximab vedotin |
| GPR40 DPP-4 | Diabetes, eg, diabetes mellitus | Fasiglifam trelagliptin |
| VEFGR-1 receptor VEFGR-2 receptor | Cancer, eg, non-squamous non-small cell lung cancer | Motesanib Motesanib diphosphate |

TABLE 5-continued

TOIs & Related Diseases, Conditions and Example Ligands

| Human TOI | Example Disease or Condition | Example Ligand |
|---|---|---|
| VEFGR-3 receptor | | |
| PDGFR | | |
| cKit | | |
| amyloid β | Alzheimer's disease | Solanezumab |
| TNF alpha | Inflammatory disease, eg, rheumatoid arthritis, psoriasis, chrohn's disease, IBD, ulcerative colitis, Psoriatic Arthritis | SIMPONI™ HUMIRA™ REMICADE™ ENBREL™ Adalimumab |
| IL-21 | Autoimmune disease or condition Inflammatory disease or condition Rheumatoid arthritis Crohn's disease IBD Ulcerative colitis Systemic lupus erythematosus (SLE) Graft versus host disease Cancer Metastatic melanoma Renal cell carcinoma Melanoma Solid tumours Acute myeloid leukaemia Non-Hodgkin's lymphoma Ovarian cancer Colorectal cancer | Agonist or antagonist antibody specific for human IL-21 NNC0114-0005 NNC0114-0006 NN8828 ATR-107 Said or an anti-IL-21 antibody in combination with an agent selected from the group consisting of ipilimumab (eg, to treat melanoma), an anti-PD1 antibody (eg, to treat solid tumours), sunitinib (eg, to treat renal cell carcinoma), rituximab (eg, to treat Non-Hodgkin's lymphoma), sorafenib (eg, to treat renal cell carcinoma), doxorubicin (eg, to treat ovarian cancer) and cetuximab (eg, to treat colorectal cancer). |

TABLE 6

PCSK9 SEQUENCES

| FORM/ ALLELE | VERSION | SEQUENCE | SEQ ID NO: |
|---|---|---|---|

AMINO ACID SEQUENCES

*Italics* = Signal sequence 1-30
`Courier` = pro peptide 31-152
lower case = catalytic domain 153-449
UPPER CASE = C-terminal domain 450-692
Underlined = residues changed from allele a in other sequences (aa residue number shown)

| | | | |
|---|---|---|---|
| a | Pro-Form with Signal Sequence | *MGTVSSRRSWWPLPLLLLLLLLLGPAGARA* QEDEDGDYEELVLAL<u>R</u>SEEDGL<u>A</u>EAPEHGTTATFHRCAKDP (46, 53)<br>WRLPGTYVVVLKEETHLSQSERTARRLQAQAARRGYLTKILHVFHGLLPGFLVKMSGDLLELALKLPH<br>VDYIEEDSSVFAQsipwnleritppryradeyqppdggslvevylldtsiqsdhreiegrvmvtdfenvpeedgtrfhrqaskcdshg<br>thlagvvsgrdagvakgasmrslrvlncqgkgtvsgtliglefirksqlvqpvgplvvllplaggysrvlnaacqrlaragvvlvtaagnfrddacly<br>spasapevitvgatnaqdqpvtlgtlgtnfgrcvdlfapgediigassdcstcfvsqsgtsqaaahvagiaammlsaepeltlaelrqrlihfsak (425, 443)<br>dv<u>i</u>neawfpedqrvltpnlvaalppsthGAGWQLFCRTVWSAHSGPTRMATA<u>I</u>ARCAPDEELLSCSSFSRSGKRRGERM (474)<br>EAQGGKLVCRAHNAFGGEGVYAIARCCLLPQANCSVHTAPPAEASMGTRVHCHQQGHVLTGCSSHWEVEDLGT (619, 620)<br>HKPPVLRPRGQPNQCVGHREASIHASCCHAPGLECKVKEHGIPAPQEQVTVACEEGWTLTGCSALPGTSHVLGAY (670)<br>AVDNTCVVRSRDVSTTGSTSE<u>E</u>AVTAVAICCRSRHLAQASQELQ | 1 |
| a | Pro-Form | QEDEDGDYEELVLAL<u>R</u>SEEDGL<u>A</u>EAPEHGTTATFHRCAKDP<br>WRLPGTYVVVLKEETHLSQSERTARRLQAQAARRGYLTKILHVFHGLLPGFLVKMSGDLLELALKLPH | 2 |

TABLE 6-continued

PCSK9 SEQUENCES

| FORM/ALLELE | VERSION | SEQUENCE | SEQ ID NO: |
|---|---|---|---|
| | | VDYIEEDSSVFAQsipwnleritppryradayqppdggslvevylldtsiqsdhreiegrvmvtdfenvpeedgtrfhrqaskcdshg<br>thlagvvsgrdagvakgasmrslrvlncqgkgtvsgtliglefirksqlvqpvgplvvllplaggysrvlnaacqrlaragvvlvtaagnfrddacly<br>spasapevitvgatnaqdqpvtlgtlgtnfgrcvdlfapgediigassdcstcfvsqsgtsqaaahvagiaammlsaepeltlaelrqrlihfsak<br>      425             443                      474<br>dv<u>i</u>neawfpedqrvltpnlva<u>a</u>lppsthGAGWQLFCRTVWSAHSGPTRMATA<u>I</u>ARCAPDEELLSCSSFSRSGKRRGERM<br>EAQGGKLVCRAHNAFGGEGVYAIARCCLLPQANCSVHTAPPAEASMGTRVHCHQQGHVLTGCSSHWEVEDLGT<br>                                        619 620<br>HKPPVLRPRGQPNQCVGHREASIHASCCHAPGLECKVKEHGIPAPQ<u>E</u>QVTVACEEGWTLTGCSALPGTSHVLGAY<br>                    670<br>AVDNTCVVRSRDVSTTGSTSE<u>E</u>AVTAVAICCRSRHLAQASQELQ | |
| a | Mature form | sipwnleritppryradayqppdggslvevylldtsiqsdhreiegrvmvtdfenvpeedgtrfhrqaskcdshg<br>thlagvvsgrdagvakgasmrslrvlncqgkgtvsgtliglefirksqlvqpvgplvvllplaggysrvlnaacqrlaragvvlvtaagnfrddacly<br>spasapevitvgatnaqdqpvtlgtlgtnfgrcvdlfapgediigassdcstcfvsqsgtsqaaahvagiaammlsaepeltlaelrqrlihfsak<br>      425             443                      474<br>dv<u>i</u>neawfpedqrvltpnlva<u>a</u>lppsthGAGWQLFCRTVWSAHSGPTRMATA<u>I</u>ARCAPDEELLSCSSFSRSGKRRGERM<br>EAQGGKLVCRAHNAFGGEGVYAIARCCLLPQANCSVHTAPPAEASMGTRVHCHQQGHVLTGCSSHWEVEDLGT<br>                                      619 620<br>HKPPVLRPRGQPNQCVGHREASIHASCCHAPGLECKVKEHGIPAPQ<u>E</u>QVTVACEEGWTLTGCSALPGTSHVLGAY<br>                    670<br>AVDNTCVVRSRDVSTTGSTSE<u>E</u>AVTAVAICCRSRHLAQASQELQ | 3 |
| f | Pro-Form with Signal Sequence |                                             46        53<br>*MGTVSSRRSWWPLPLLLLLLLLLGPAGARA* QEDEDGDYEELVLAL<u>R</u>SEEDGLA<u>E</u>APEHGTTATFHRCAKDP<br>WRLPGTYVVVLKEETHLSQSERTARRLQAQAARRGYLTKILHVFHGLLPGFLVKMSGDLLELALKLPH<br>VDYIEEDSSVFAQsipwnleritppryradayqppdggslvevylldtsiqsdhreiegrvmvtdfenvpeedgtrfhrqaskcdshg<br>thlagvvsgrdagvakgasmrslrvlncqgkgtvsgtliglefirksqlvqpvgplvvllplaggysrvlnaacqrlaragvvlvtaagnfrddacly<br>spasapevitvgatnaqdqpvtlgtlgtnfgrcvdlfapgediigassdcstcfvsqsgtsqaaahvagiaammlsaepeltlaelrqrlihfsak<br>      425             443                      474<br>dv<u>i</u>neawfpedqrvltpnlva<u>a</u>lppsthGAGWQLFCRTVWSAHSGPTRMATA<u>V</u>ARCAPDEELLSCSSFSRSGKRRGERM<br>EAQGGKLVCRAHNAFGGEGVYAIARCCLLPQANCSVHTAPPAEASMGTRVHCHQQGHVLTGCSSHWEVEDLGT<br>                                        619 620<br>HKPPVLRPRGQPNQCVGHREASIHASCCHAPGLECKVKEHGIPAPQ<u>E</u>QVTVACEEGWTLTGCSALPGTSHVLGAY<br>                    670<br>AVDNTCVVRSRDVSTTGSTSE<u>E</u>AVTAVAICCRSRHLAQASQELQ | 4 |
| f | Pro-Form | QEDEDGDYEELVLAL<u>R</u>SEEDGLA<u>E</u>APEHGTTATFHRCAKDP<br>WRLPGTYVVVLKEETHLSQSERTARRLQAQAARRGYLTKILHVFHGLLPGFLVKMSGDLLELALKLPH<br>VDYIEEDSSVFAQsipwnleritppryradayqppdggslvevylldtsiqsdhreiegrvmvtdfenvpeedgtrfhrqaskcdshg<br>thlagvvsgrdagvakgasmrslrvlncqgkgtvsgtliglefirksqlvqpvgplvvllplaggysrvlnaacqrlaragvvlvtaagnfrddacly<br>spasapevitvgatnaqdqpvtlgtlgtnfgrcvdlfapgediigassdcstcfvsqsgtsqaaahvagiaammlsaepeltlaelrqrlihfsak<br>      425             443                      474<br>dv<u>i</u>neawfpedqrvltpnlva<u>a</u>lppsthGAGWQLFCRTVWSAHSGPTRMATA<u>V</u>ARCAPDEELLSCSSFSRSGKRRGERM<br>EAQGGKLVCRAHNAFGGEGVYAIARCCLLPQANCSVHTAPPAEASMGTRVHCHQQGHVLTGCSSHWEVEDLGT<br>                                        619 620<br>HKPPVLRPRGQPNQCVGHREASIHASCCHAPGLECKVKEHGIPAPQ<u>E</u>QVTVACEEGWTLTGCSALPGTSHVLGAY<br>                    670<br>AVDNTCVVRSRDVSTTGSTSE<u>E</u>AVTAVAICCRSRHLAQASQELQ | 5 |
| f, p, aj | Mature form | sipwnleritppryradayqppdggslvevylldtsiqsdhreiegrvmvtdfenvpeedgtrfhrqaskcdshg<br>thlagvvsgrdagvakgasmrslrvlncqgkgtvsgtliglefirksqlvqpvgplvvllplaggysrvlnaacqrlaragvvlvtaagnfrddacly<br>spasapevitvgatnaqdqpvtlgtlgtnfgrcvdlfapgediigassdcstcfvsqsgtsqaaahvagiaammlsaepeltlaelrqrlihfsak<br>      425             443                      474<br>dv<u>i</u>neawfpedqrvltpnlva<u>a</u>lppsthGAGWQLFCRTVWSAHSGPTRMATA<u>V</u>ARCAPDEELLSCSSFSRSGKRRGERM<br>EAQGGKLVCRAHNAFGGEGVYAIARCCLLPQANCSVHTAPPAEASMGTRVHCHQQGHVLTGCSSHWEVEDLGT<br>                                      619 620<br>HKPPVLRPRGQPNQCVGHREASIHASCCHAPGLECKVKEHGIPAPQ<u>E</u>QVTVACEEGWTLTGCSALPGTSHVLGAY<br>                    670<br>AVDNTCVVRSRDVSTTGSTSE<u>E</u>AVTAVAICCRSRHLAQASQELQ | 6 |

TABLE 6-continued

PCSK9 SEQUENCES

| FORM/ ALLELE | VERSION | SEQUENCE | SEQ ID NO: |
|---|---|---|---|
| c | Pro-Form with Signal Sequence | *MGTVSSRRSWWPLPLLLLLLLLLGPAGARA* QEDEDGDYEELVLAL<u>R</u>SEEDGL<u>A</u>EAPEHGTTATFHRCAKDP (46, 53)<br>WRLPGTYVVVLKEETHLSQSERTARRLQAQAARRGYLTKILHVFHGLLPGFLVKMSGDLLELALKLPH<br>VDYIEEDSSVFAQsipwnleritppryradeyqppdggslvevylldtsiqsdhreiegrvmvtdfenvpeedgtrfhrqaskcdshg<br>thlagvvsgrdagvakgasmrslrvlncqgkgtvsgtliglefirksqlvqpvgplvvllplaggysrvlnaacqrlaragvvlvtaagnfrddacly<br>spasapevitvgatnaqdqpvtlgtlgtnfgrcvdlfapgediigassdcstcfvsqsgtsqaaahvagiaammlsaepeltlaelrqrlihfsak<br>(425, 443, 474)<br>dv<u>i</u>neawfpedqrvltpnlvaa<u>l</u>ppsthGAGWQLFCRTVWSAHSGPTRMATA<u>I</u>ARCAPDEELLSCSSFSRSGKRRGERM<br>EAQGGKLVCRAHNAFGGEGVYAIARCCLLPQANCSVHTAPPAEASMGTRVHCHQQGHVLTGCSSHWEVEDLGT<br>HKPPVLRPRGQPNQCVGHREASIHASCCHAPGLECKVKEHGIPAPQ<u>E</u>QVTVACEEGWTLTGCSALPGTSHVLGAY (619, 620)<br>AVDNTCVVRSRDVSTTGSTSE<u>GA</u>VTAVAICCRSRHLAQASQELQ (670) | 7 |
| c | Pro-Form | QEDEDGDYEELVLAL<u>R</u>SEEDGL<u>A</u>EAPEHGTTATFHRCAKDP<br>WRLPGTYVVVLKEETHLSQSERTARRLQAQAARRGYLTKILHVFHGLLPGFLVKMSGDLLELALKLPH<br>VDYIEEDSSVFAQsipwnleritppryradeyqppdggslvevylldtsiqsdhreiegrvmvtdfenvpeedgtrfhrqaskcdshg<br>thlagvvsgrdagvakgasmrslrvlncqgkgtvsgtliglefirksqlvqpvgplvvllplaggysrvlnaacqrlaragvvlvtaagnfrddacly<br>spasapevitvgatnaqdqpvtlgtlgtnfgrcvdlfapgediigassdcstcfvsqsgtsqaaahvagiaammlsaepeltlaelrqrlihfsak<br>(425, 443, 474)<br>dv<u>i</u>neawfpedqrvltpnlvaa<u>l</u>ppsthGAGWQLFCRTVWSAHSGPTRMATA<u>I</u>ARCAPDEELLSCSSFSRSGKRRGERM<br>EAQGGKLVCRAHNAFGGEGVYAIARCCLLPQANCSVHTAPPAEASMGTRVHCHQQGHVLTGCSSHWEVEDLGT<br>HKPPVLRPRGQPNQCVGHREASIHASCCHAPGLECKVKEHGIPAPQ<u>E</u>QVTVACEEGWTLTGCSALPGTSHVLGAY (619, 620)<br>AVDNTCVVRSRDVSTTGSTSE<u>GA</u>VTAVAICCRSRHLAQASQELQ (670) | 8 |
| c, q | Mature form | sipwnleritppryradayqppdggslvevylldtsiqsdhreiegrvmvtdfenvpeedgtrfhrqaskcdshg<br>thlagvvsgrdagvakgasmrslrvlncqgkgtvsgtliglefirksqlvqpvgplvvllplaggysrvlnaacqrlaragvvlvtaagnfrddacly<br>spasapevitvgatnaqdqpvtlgtlgtnfgrcvdlfapgediigassdcstcfvsqsgtsqaaahvagiaammlsaepeltlaelrqrlihfsak<br>(425, 443, 474)<br>dv<u>i</u>neawfpedqrvltpnlvaa<u>l</u>ppsthGAGWQLFCRTVWSAHSGPTRMATA<u>I</u>ARCAPDEELLSCSSFSRSGKRRGERM<br>EAQGGKLVCRAHNAFGGEGVYAIARCCLLPQANCSVHTAPPAEASMGTRVHCHQQGHVLTGCSSHWEVEDLGT<br>HKPPVLRPRGQPNQCVGHREASIHASCCHAPGLECKVKEHGIPAPQ<u>E</u>QVTVACEEGWTLTGCSALPGTSHVLGAY (619, 620)<br>AVDNTCVVRSRDVSTTGSTSE<u>GA</u>VTAVAICCRSRHLAQASQELQ (670) | 9 |
| r | Pro-Form with Signal Sequence | *MGTVSSRRSWWPLPLLLLLLLLLGPAGARA*QEDEDGDYEELVLAL<u>R</u>SEEDGL<u>A</u>EAPEHGTTATFHRCAKDF (46, 53)<br>WRLPGTYVVVLKEETHLSQSERTARRLQAQAARRGYLTKILHVFHGLLPGFLVKMSGDLLELALKLPH<br>VDYIEEDSSVFAQsipwnleritppryradeyqppdggslvevylldtsiqsdhreiegrvmvtdfenvpeedgtrfhrqaskcdshg<br>thlagvvsgrdagvakgasmrslrvlncqgkgtvsgtliglefirksqlvqpvgplvvllplaggysrvlnaacqrlaragvvlvtaagnfrddacly<br>spasapevitvgatnaqdqpvtlgtlgtnfgrcvdlfapgediigassdcstcfvsqsgtsqaaahvagiaammlsaepeltlaelrqrlihfsak<br>(425, 443, 474)<br>dv<u>i</u>neawfpedqrvltpnlvaa<u>l</u>ppsthGAGWQLFCRTVWSAHSGPTRMATA<u>V</u>ARCAPDEELLSCSSFSRSGKRRGERM<br>EAQGGKLVCRAHNAFGGEGVYAIARCCLLPQANCSVHTAPPAEASMGTRVHCHQQGHVLTGCSSHWEVEDLGT<br>HKPPVLRPRGQPNQCVGHREASIHASCCHAPGLECKVKEHGIPAPQ<u>E</u>QVTVACEEGWTLTGCSALPGTSHVLGAY (619, 620)<br>AVDNTCVVRSRDVSTTGSTSE<u>GA</u>VTAVAICCRSRHLAQASQELQ (670) | 10 |
| r | Pro-Form | QEDEDGDYEELVLAL<u>R</u>SEEDGL<u>A</u>EAPEHGTTATFHRCAKDP<br>WRLPGTYVVVLKEETHLSQSERTARRLQAQAARRGYLTKILHVFHGLLPGFLVKMSGDLLELALKLPH<br>VDYIEEDSSVFAQsipwnleritppryradeyqppdggslvevylldtsiqsdhreiegrvmvtdfenvpeedgtrfhrqaskcdshg<br>thlagvvsgrdagvakgasmrslrvlncqgkgtvsgtliglefirksqlvqpvgplvvllplaggysrvlnaacqrlaragvvlvtaagnfrddacly<br>spasapevitvgatnaqdqpvtlgtlgtnfgrcvdlfapgediigassdcstcfvsqsgtsqaaahvagiaammlsaepeltlaelrqrlihfsak | 11 |

TABLE 6-continued

PCSK9 SEQUENCES

| FORM/ALLELE | VERSION | SEQUENCE | SEQ ID NO: |
|---|---|---|---|
| | |           425          443                    474<br>dvineawfpedqrvltpnlvaalppsthGAGWQLFCRTVWSAHSGPTRMATAVARCAPDEELLSCSSFSRSGKRRGERM<br>EAQGGKLVCRAHNAFGGEGVYAIARCCLLPQANCSVHTAPPAEASMGTRVHCHQQGHVLTGCSSHWEVEDLGT<br>                                  619 620<br>HKPPVLRPRGQPNQCVGHREASIHASCCHAPGLECKVKEHGIPAPQEQVTVACEEGWTLTGCSALPGTSHVLGAY<br>                      670<br>AVDNTCVVRSRDVSTTGSTSEGAVTAVAICCRSRHLAQASQELQ | |
| r | Mature form | sipwnleritppryradayqppdggslvevylldtsiqsdhreiegrvmvtdfenvpeedgtrfhrqaskcdshg<br>thlagvvsgrdagvakgasmrslrvlncqgkgtvsgtliglefirksqlvqpvgplvvllplaggysrvlnaacqrlaragvvlvtaagnfrddacly<br>spasapevitvgatnaqdqpvtlgtlgtnfgrcvdlfapgediigassdcstcfvsqsgtsqaaahvagiaammlsaepeltlaelrqrlihfsak<br>          425          443                    474<br>dvineawfpedqrvltpnlvaalppsthGAGWQLFCRTVWSAHSGPTRMATAVARCAPDEELLSCSSFSRSGKRRGERM<br>EAQGGKLVCRAHNAFGGEGVYAIARCCLLPQANCSVHTAPPAEASMGTRVHCHQQGHVLTGCSSHWEVEDLGT<br>                                  619 620<br>HKPPVLRPRGQPNQCVGHREASIHASCCHAPGLECKVKEHGIPAPQEQVTVACEEGWTLTGCSALPGTSHVLGAY<br>                      670<br>AVDNTCVVRSRDVSTTGSTSEGAVTAVAICCRSRHLAQASQELQ | 12 |
| p | Pro-Form with Signal Sequence |                                                 46       53<br>MGTVSSRRSWWPLPLLLLLLLLLGPAGARAQEDEDGDYEELVLALRSEEDGLVEAPEHGTTATFHRCAKDP<br>WRLPGTYVVVLKEETHLSQSERTARRLQAQAARRGYLTKILHVFHGLLPGFLVKMSGDLLELALKLPH<br>VDYIEEDSSVFAQsipwnleritppryradeyqppdggslvevylidtsiqsdhreiegrvmvtdgenpeedgtrfhrqaskcdshg<br>thlagvvsgrdagvakgasmrslrvlncqgkgtvsgtliglefirksqlvqpvgplvvllplaggysrvlnaacqrlaragvvlvtaagnfrddacly<br>spasapevitvgatnaqdqpvtlgtlgtnfgrcvdlfapgediigassdcstcfvsqsgtsqaaahvagiaammlsaepeltlaelrqrlihfsak<br>          425          443                    474<br>dvineawfpedqrvltpnlvaalppsthGAGWQLFCRTVWSAHSGPTRMATAVARCAPDEELLSCSSFSRSGKRRGERM<br>EAQGGKLVCRAHNAFGGEGVYAIARCCLLPQANCSVHTAPPAEASMGTRVHCHQQGHVLTGCSSHWEVEDLGT<br>                                  619 620<br>HKPPVLRPRGQPNQCVGHREASIHASCCHAPGLECKVKEHGIPAPQEQVTVACEEGWTLTGCSALPGTSHVLGAY<br>                      670<br>AVDNTCVVRSRDVSTTGSTSEEAVTAVAICCRSRHLAQASQELQ | 13 |
| p | Pro-Form | QEDEDGDYEELVLALRSEEDGLVEAPEHGTTATFHRCAKDP<br>WRLPGTYVVVLKEETHLSQSERTARRLQAQAARRGYLTKILHVFHGLLPGFLVKMSGDLLELALKLPH<br>VDYIEEDSSVFAQsipwnleritppryradeyqppdggslvevylidtsiqsdhreiegrvmvtdgenpeedgtrfhrqaskcdshg<br>thlagvvsgrdagvakgasmrslrvlncqgkgtvsgtliglefirksqlvqpvgplvvllplaggysrvlnaacqrlaragvvlvtaagnfrddacly<br>spasapevitvgatnaqdqpvtlgtlgtnfgrcvdlfapgediigassdcstcfvsqsgtsqaaahvagiaammlsaepeltlaelrqrlihfsak<br>          425          443                    474<br>dvineawfpedqrvltpnlvaalppsthGAGWQLFCRTVWSAHSGPTRMATAVARCAPDEELLSCSSFSRSGKRRGERM<br>EAQGGKLVCRAHNAFGGEGVYAIARCCLLPQANCSVHTAPPAEASMGTRVHCHQQGHVLTGCSSHWEVEDLGT<br>                                  619 620<br>HKPPVLRPRGQPNQCVGHREASIHASCCHAPGLECKVKEHGIPAPQEQVTVACEEGWTLTGCSALPGTSHVLGAY<br>                      670<br>AVDNTCVVRSRDVSTTGSTSEEAVTAVAICCRSRHLAQASQELQ | 14 |
| m | Pro-Form with Signal Sequence |                                                 46       53<br>MGTVSSRRSWWPLPLLLLLLLLLGPAGARAQEDEDGDYEELVLALRSEEDGLAEAPEHGTTATFHRCAKDP<br>WRLPGTYVVVLKEETHLSQSERTARRLQAQAARRGYLTKILHVFHGLLPGFLVKMSGDLLELALKLPH<br>VDYIEEDSSVFAQsipwnleritppryradeyqppdggslvevylidtsiqsdhreiegrvmvtdgenpeedgtrfhrqaskcdshg<br>thlagvvsgrdagvakgasmrslrvlncqgkgtvsgtliglefirksqlvqpvgplvvllplaggysrvlnaacqrlaragvvlvtaagnfrddacly<br>spasapevitvgatnaqdqpvtlgtlgtnfgrcvdlfapgediigassdcstcfvsqsgtsqaaahvagiaammlsaepeltlaelrqrlihfsak<br>          425          443                    474<br>dvineawfpedqrvltpnlvatlppsthGAGWQLFCRTVWSAHSGPTRMATAIARCAPDEELLSCSSFSRSGKRRGERM<br>EAQGGKLVCRAHNAFGGEGVYAIARCCLLPQANCSVHTAPPAEASMGTRVHCHQQGHVLTGCSSHWEVEDLGT<br>                                  619 620<br>HKPPVLRPRGQPNQCVGHREASIHASCCHAPGLECKVKEHGIPAPQEQVTVACEEGWTLTGCSALPGTSHVLGAY | 15 |

TABLE 6-continued

PCSK9 SEQUENCES

| FORM/<br>ALLELE | VERSION | SEQUENCE | SEQ<br>ID<br>NO: |
|---|---|---|---|
| | | 670<br>AVDNTCVVRSRDVSTTGSTSEEAVTAVAICCRSRHLAQASQELQ | |
| m | Pro-Form | QEDEDGDYEELVLALRSEEDGLAEAPEHGTTATFHRCAKDP<br><br>WRLPGTYVVVLKEETHLSQSERTARRLQAQAARRGYLTKILHVFHGLLPGFLVKMSGDLLELALKLPH<br><br>VDYIEEDSSVFAQsipwnleritppryradeyqppdggslvevylldtsiqsdhreiegrvmvtdfenvpeedgtrfhrqaskcdshg<br><br>thlagvvsgrdagvakgasmrslrvlncqgkgtvsgtligleﬁrksqlvqpvgplvvllplaggysrvlnaacqrlaragvvlvtaagnfrddacly<br>spasapevitvgatnaqdqpvtlgtlgtnfgrcvdlfapgediigassdcstcfvsqsgtsqaaahvagiaammlsaepeltlaelrqrlihfsak<br>425            443             474<br>dvineawfpedqrvltpnlvatlppsthGAGWQLFCRTVWSAHSGPTRMATAIARCAPDEELLSCSSFSRSGKRRGERM<br>EAQGGKLVCRAHNAFGGEGVYAIARCCLLPQANCSVHTAPPAEASMGTRVHCHQQGHVLTGCSSHWEVEDLGT<br>                                               619 620<br>HKPPVLRPRGQPNQCVGHREASIHASCCHAPGLECKVKEHGIPAPQEQVTVACEEGWTLTGCSALPGTSHVLGAY<br>670<br>AVDNTCVVRSRDVSTTGSTSEEAVTAVAICCRSRHLAQASQELQ | 16 |
| m | Mature<br>form | sipwnleritppryradayqppdggslvevylldtsiqsdhreiegrvmvtdfenvpeedgtrfhrqaskcdshg<br>thlagvvsgrdagvakgasmrslrvlncqgkgtvsgtligleﬁrksqlvqpvgplvvllplaggysrvlnaacqrlaragvvlvtaagnfrddacly<br>spasapevitvgatnaqdqpvtlgtlgtnfgrcvdlfapgediigassdcstcfvsqsgtsqaaahvagiaammlsaepeltlaelrqrlihfsak<br>425            443             474<br>dvineawfpedqrvltpnlvatlppsthGAGWQLFCRTVWSAHSGPTRMATAIARCAPDEELLSCSSFSRSGKRRGERM<br>EAQGGKLVCRAHNAFGGEGVYAIARCCLLPQANCSVHTAPPAEASMGTRVHCHQQGHVLTGCSSHWEVEDLGT<br>                                               619 620<br>HKPPVLRPRGQPNQCVGHREASIHASCCHAPGLECKVKEHGIPAPQEQVTVACEEGWTLTGCSALPGTSHVLGAY<br>670<br>AVDNTCVVRSRDVSTTGSTSEEAVTAVAICCRSRHLAQASQELQ | 17 |
| e | Pro-Form<br>with<br>Signal<br>Sequence |                                      46           53<br>*MGTVSSRRSWWPLPLLLLLLLLLGPAGARA*QEDEDGDYEELVLALRSEEDGLAEAPEHGTTATFHRCAKDP<br>WRLPGTYVVVLKEETHLSQSERTARRLQAQAARRGYLTKILHVFHGLLPGFLVKMSGDLLELALKLPH<br><br>VDYIEEDSSVFAQsipwnleritppryradeyqppdggslvevylldtsiqsdhreiegrvmvtdfenvpeedgtrfhrqaskcdshg<br><br>thlagvvsgrdagvakgasmrslrvlncqgkgtvsgtligleﬁrksqlvqpvgplvvllplaggysrvlnaacqrlaragvvlvtaagnfrddacly<br>spasapevitvgatnaqdqpvtlgtlgtnfgrcvdlfapgediigassdcstcfvsqsgtsqaaahvagiaammlsaepeltlaelrqrlihfsak<br>425            443             474<br>dviseawfpedqrvltpnlvaalppsthGAGWQLFCRTVWSAHSGPTRMATAVARCAPDEELLSCSSFSRSGKRRGERM<br>EAQGGKLVCRAHNAFGGEGVYAIARCCLLPQANCSVHTAPPAEASMGTRVHCHQQGHVLTGCSSHWEVEDLGT<br>                                             619 620<br>HKPPVLRPRGQPNQCVGHREASIHASCCHAPGLECKVKEHGIPAPQEQVTVACEEGWTLTGCSALPGTSHVLGAY<br>670<br>AVDNTCVVRSRDVSTTGSTSEEAVTAVAICCRSRHLAQASQELQ | 18 |
| e | Pro-Form | QEDEDGDYEELVLALRSEEDGLAEAPEHGTTATFHRCAKDP<br><br>WRLPGTYVVVLKEETHLSQSERTARRLQAQAARRGYLTKILHVFHGLLPGFLVKMSGDLLELALKLPH<br><br>VDYIEEDSSVFAQsipwnleritppryradeyqppdggslvevylldtsiqsdhreiegrvmvtdfenvpeedgtrfhrqaskcdshg<br><br>thlagvvsgrdagvakgasmrslrvlncqgkgtvsgtligleﬁrksqlvqpvgplvvllplaggysrvlnaacqrlaragvvlvtaagnfrddacly<br>spasapevitvgatnaqdqpvtlgtlgtnfgrcvdlfapgediigassdcstcfvsqsgtsqaaahvagiaammlsaepeltlaelrqrlihfsak<br>425            443             474<br>dviseawfpedqrvitpnlvaalppsthGAGWQLFCRTVWSAHSGPTRMATAVARCAPDEELLSCSSFSRSGKRRGERM<br>EAQGGKLVCRAHNAFGGEGVYAIARCCLLPQANCSVHTAPPAEASMGTRVHCHQQGHVLTGCSSHWEVEDLGT<br>                                           619 620<br>HKPPVLRPRGQPNQCVGHREASIHASCCHAPGLECKVKEHGIPAPQEQVTVACEEGWTLTGCSALPGTSHVLGAY<br>670<br>AVDNTCVVRSRDVSTTGSTSEEAVTAVAICCRSRHLAQASQELQ | 19 |
| e | Mature<br>form | sipwnleritppryradayqppdggslvevylldtsiqsdhreiegrvmvtdfenvpeedgtrfhrqaskcdshg<br>thlagvvsgrdagvakgasmrslrvlncqgkgtvsgtligleﬁrksqlvqpvgplvvllplaggysrvlnaacqrlaragvvlvtaagnfrddacly<br>spasapevitvgatnaqdqpvtlgtlgtnfgrcvdlfapgediigassdcstcfvsqsgtsqaaahvagiaammlsaepeltlaelrqrlihfsak<br>425            443             474<br>dviseawfpedqrvitpnlvaalppsthGAGWQLFCRTVWSAHSGPTRMATAVARCAPDEELLSCSSFSRSGKRRGERM<br>EAQGGKLVCRAHNAFGGEGVYAIARCCLLPQANCSVHTAPPAEASMGTRVHCHQQGHVLTGCSSHWEVEDLGT | 20 |

TABLE 6-continued

PCSK9 SEQUENCES

| FORM/ ALLELE | VERSION | SEQUENCE | SEQ ID NO: |
|---|---|---|---|
| | | 619 620<br>HKPPVLRPRGQPNQCVGHREASIHASCCHAPGLECKVKEHGIPAPQEQVTVACEEGWTLTGCSALPGTSHVLGAY<br>670<br>AVDNTCVVRSRDVSTTGSTSEEAVTAVAICCRSRHLAQASQELQ | |
| h | Pro-Form with Signal Sequence | 46 53<br>*MGTVSSRRSWWPLPLLLLLLLLLGPAGARA*QEDEDGDYEELVLALRSEEDGLAEAPEHGTTATFHRCAKDP<br>WRLPGTYVVVLKEETHLSQSERTARRLQAQAARRGYLTKILHVFHGLLPGFLVKMSGDLLELALKLPH<br>VDYIEEDSSVFAQsipwnleritppryradeyqppdggslvevylldtsiqsdhreiegrvmvtdfenvpeedgtrfhrqaskcdshg<br>thlagvvsgrdagvakgasmrslrvlncqgkgtvsgtliglefirksqlvqpvgplvvllplaggysrvlnaacqrlaragvvlvtaagnfrddacly<br>spasapevitvgatnaqdqpvtlgtlgtnfgrcvdlfapgediigassdcstcfvsqsgtsqaaahvagiaammlsaepeltlaelrqrlihfsak<br>425 443 474<br>dvineawfpedqrvltpnlvatlppsthGAGWQLFCRTVWSAHSGPTRMATAIARCAPDEELLSCSSFSRSGKRRGERM<br>EAQGGKLVCRAHNAFGGEGVYAIARCCLLPQANCSVHTAPPAEASMGTRVHCHQQGHVLTGCSSHWEVEDLGT<br>619 620<br>HKPPVLRPRGQPNQCVGHREASIHASCCHAPGLECKVKEHGIPAPPEQVTVACEEGWTLTGCSALPGTSHVLGAY<br>670<br>AVDNTCVVRSRDVSTTGSTSEEAVTAVAICCRSRHLAQASQELQ | 21 |
| h | Pro-Form | QEDEDGDYEELVLALRSEEDGLAEAPEHGTTATFHRCAKDP<br>WRLPGTYVVVLKEETHLSQSERTARRLQAQAARRGYLTKILHVFHGLLPGFLVKMSGDLLELALKLPH<br>VDYIEEDSSVFAQsipwnleritppryradeyqppdggslvevylldtsiqsdhreiegrvmvtdfenvpeedgtrfhrqaskcdshg<br>thlagvvsgrdagvakgasmrslrvlncqgkgtvsgtliglefirksqlvqpvgplvvllplaggysrvlnaacqrlaragvvlvtaagnfrddacly<br>spasapevitvgatnaqdqpvtlgtlgtnfgrcvdlfapgediigassdcstcfvsqsgtsqaaahvagiaammlsaepeltlaelrqrlihfsak<br>425 443 474<br>dvineawfpedqrvltpnlvatlppsthGAGWQLFCRTVWSAHSGPTRMATAIARCAPDEELLSCSSFSRSGKRRGERM<br>EAQGGKLVCRAHNAFGGEGVYAIARCCLLPQANCSVHTAPPAEASMGTRVHCHQQGHVLTGCSSHWEVEDLGT<br>619 620<br>HKPPVLRPRGQPNQCVGHREASIHASCCHAPGLECKVKEHGIPAPPEQVTVACEEGWTLTGCSALPGTSHVLGAY<br>670<br>AVDNTCVVRSRDVSTTGSTSEEAVTAVAICCRSRHLAQASQELQ | 22 |
| h | Mature form | sipwnleritppryradayqppdggslvevylldtsiqsdhreiegrvmvtdfenvpeedgtrfhrqaskcdshg<br>thlagvvsgrdagvakgasmrslrvlncqgkgtvsgtliglefirksqlvqpvgplvvllplaggysrvlnaacqrlaragvvlvtaagnfrddacly<br>spasapevitvgatnaqdqpvtlgtlgtnfgrcvdlfapgediigassdcstcfvsqsgtsqaaahvagiaammlsaepeltlaelrqrlihfsak<br>425 443 474<br>dvineawfpedqrvltpnlvatlppsthGAGWQLFCRTVWSAHSGPTRMATAIARCAPDEELLSCSSFSRSGKRRGERM<br>EAQGGKLVCRAHNAFGGEGVYAIARCCLLPQANCSVHTAPPAEASMGTRVHCHQQGHVLTGCSSHWEVEDLGT<br>619 620<br>HKPPVLRPRGQPNQCVGHREASIHASCCHAPGLECKVKEHGIPAPPEQVTVACEEGWTLTGCSALPGTSHVLGAY<br>670<br>AVDNTCVVRSRDVSTTGSTSEEAVTAVAICCRSRHLAQASQELQ | 23 |
| aj | Pro-Form with Signal Sequence | 46 53<br>*MGTVSSRRSWWPLPLLLLLLLLLGPAGARA* QEDEGDYEELVLALLSEEDGLAEAPEHGTTATFHRCAKDP<br>WRLPGTYVVVLKEETHLSQSERTARRLQAQAARRGYLTKILHVFHGLLPGFLVKMSGDLLELALKLPH<br>VDYIEEDSSVFAQsipwnleritppryradeyqppdggslvevylldtsiqsdhreiegrvmvtdfenvpeedgtrfhrqaskcdshg<br>thlagvvsgrdagvakgasmrslrvlncqgkgtvsgtliglefirksqlvqpvgplvvllplaggysrvlnaacqrlaragvvlvtaagnfrddacly<br>spasapevitvgatnaqdqpvtlgtlgtnfgrcvdlfapgediigassdcstcfvsqsgtsqaaahvagiaammlsaepeltlaelrqrlihfsak<br>425 443 474<br>dvineawfpedqrvltpnfvaalppsthGAGWQLFCRTVWSAHSGPTRMATAVARCAPDEELLSCSSFSRSGKRRGERM<br>EAQGGKLVCRAHNAFGGEGVYAIARCCLLPQANCSVHTAPPAEASMGTRVHCHQQGHVLTGCSSHWEVEDLGT<br>619 620<br>HKPPVLRPRGQPNQCVGHREASIHASCCHAPGLECKVKEHGIPAPQEQVTVACEEGWTLTGCSALPGTSHVLGAY<br>570<br>AVDNTCVVRSRDVSTTGSTSEEAVTAVAICCRSRHLAQASQELQ | 24 |
| aj | Pro-Form | QEDEDGDYEELVLALLSEEDGLAEAPEHGTTATFHRCAKDP<br>WRLPGTYVVVLKEETHLSQSERTARRLQAQAARRGYLTKILHVFHGLLPGFLVKMSGDLLELALKLPH | 25 |

TABLE 6-continued

PCSK9 SEQUENCES

| FORM/ ALLELE | VERSION | SEQUENCE | SEQ ID NO: |
|---|---|---|---|
| | | VDYIEEDSSVFAQsipwnleritppryradeyqppdggslvevylldtsiqsdhreiegrvmvtdfenvpeedgtrfhrqaskcdshg thlagvvsgrdagvakgasmrslrvlncqgkgtvsgtligliefirksqlvqpvgplvvllplaggysrvlnaacqrlaragvvlvtaagnfrddacly spasapevitvgatnaqdqpvtlgtlgtnfgrcvdlfapgediigassdcstcfvsqsgtsqaaahvagiaammlsaepeltlaelrqrlihfsak 425      443      474 dvineawfpedqrvltpnlvaalppsthGAGWQLFCRTVWSAHSGPTRMATAVARCAPDEELLSCSSFSRSGKRRGERM EAQGGKLVCRAHNAFGGEGVYAIARCCLLPQANCSVHTAPPAEASMGTRVHCHQQGHVLTGCSSHWEVEDLGT 619 620 HKPPVLRPRGQPNQCVGHREASIHASCCHAPGLECKVKEHGIPAPQEQVTVACEEGWTLTGCSALPGTSHVLGAY 670 AVDNTCVVRSRDVSTTGSTSEEAVTAVAICCRSRHLAQASQELQ | |
| q | Pro-Form with Signal Sequence | 46  53 *MGTVSSRRSWWPLPLLLLLLLLLLGPAGARA* QEDEDGDYEELVLALRSEEDGLVEAPEHGTTATFHRCAKDP WRLPGTYVVVLKEETHLSQSERTARRLQAQAARRGYLTKILHVFHGLLPGFLVKMSGDLLELALKLPH VDYIEEDSSVFAQsipwnleritppryradeyqppdggslvevylldtsiqsdhreiegrvmvtdfenvpeedgtrfhrqaskcdshg thlagvvsgrdagvakgasmrslrvlncqgkgtvsgtligliefirksqlvqpvgplvvllplaggysrvlnaacqrlaragvvlvtaagnfrddacly spasapevitvgatnaqdqpvtlgtlgtnfgrcvdlfapgediigassdcstcfvsqsgtsqaaahvagiaammlsaepeltlaelrqrlihfsak 425      443      474 dvineawfpedqrvltpnlvaalppsthGAGWQLFCRTVWSAHSGPTRMATAIARCAPDEELLSCSSFSRSGKRRGERM EAQGGKLVCRAHNAFGGEGVYAIARCCLLPQANCSVHTAPPAEASMGTRVHCHQQGHVLTGCSSHWEVEDLGT 619 620 HKPPVLRPRGQPNQCVGHREASIHASCCHAPGLECKVKEHGIPAPQEQVTVACEEGWTLTGCSALPGTSHVLGAY 670 AVDNTCVVRSRDVSTTGSTSEGAVTAVAICCRSRHLAQASQELQ | 26 |
| q | Pro-Form | QEDEDGDYEELVLALRSEEDGLVEAPEHGTTATFHRCAKDF WRLPGTYVVVLKEETHLSQSERTARRLQAQAARRGYLTKILHVFHGLLPGFLVKMSGDLLELALKLPH VDYTEEDSSVFAQsipwnleritppryradeyqppdggslvevylldtsiqsdhrelegrvmvtdfenvpeedgtrfhrqaskcdshg thlagvvsgrdagvakgasmrslrvlncqgkgtvsgtligliefirksqlvqpvgplvvllplaggysrvlnaacqrlaragvvlvtaagnfrddacly spasapevitvgatnaqdqpvtlgtlgtnfgrcvdlfapgediigassdcstcfvsqsgtsqaaahvagiaammlsaepeltlaelrqrlihfsak 425      443      474 dvineawfpedqrvltpnlvaalppsthGAGWQLFCRTVWSAHSGPTRMATAIARCAPDEELLSCSSFSRSGKRRGERM EAQGGKLVCRAHNAFGGEGVYAIARCCLLPQANCSVHTAPPAEASMGTRVHCHQQGHVLTGCSSHWEVEDLGT 619 620 HKPPVLRPRGQPNQCVGHREASIHASCCHAPGLECKVKEHGIPAPQEQVTVACEEGWTLTGCSALPGTSHVLGAY 670 AVDNTCVVRSRDVSTTGSTSEGAVTAVAICCRSRHLAQASQELQ | 27 |

NUCLEOTIDE SEQUENCES

*Italics* = nucleotide sequence encoding signal sequence (nucleotides 1-90)
`Courier` = nucleotide sequence encoding pro peptide (nucleotides 91-456)

lower case = nucleotide sequence encoding catalytic domain (nucleotides 457-1346)
UPPER CASE = nucleotide sequence encoding C-terminal domain (nucleotides 1347-2076)

| | | | |
|---|---|---|---|
| a | | *ATGGGCACCGTCAGCTCCAGGCGGTCCTGGTGGCCGCTGCCACTGCTGCTGCTGCTGCTGCTCCTGGGTC* R45L CGT to CTT *CCGCGGGCGCCCCGTGCG*CAGGAGGACGAGGACGGCGACTACGAGGAGCTGGTGCTAGCCTTGCGTTCCG A53V GCC to GTC AGGAGGACGGCCTGGCCGAAGCACCCGAGCACGGAACCACAGCCACCTTCCACCGCTGCGCCAAGGAT CCGTGGAGGTTGCCTGGCACCTACGTGGTGGTGCTGAAGGAGGAGACCCACCTCTCGCAGTCAGAGCG CACTGCCCGCCGCCTGCAGGCCCAGGCTGCCCGCCGGGGATACCTCACCAAGATCCTGCATGTCTTCC ATGGCCTTCTTCCTGGCTTCCTGGTGAAGATGAGTGGCGACCTGCTGGAGCTGGCCTTGAAGTTGCCC CATGTCGACTACATCGAGGAGGACTCCTCTGTCTTTGCCCAGagcatcccgtggaacctggagcggattacccctcca cggtaccgggcggatgaataccagcccccgacggaggcagcctggtggaggtgtatctcctagacaccagcatacagagtgaccaccgggaa atcgagggcagggtcatggtcaccgacttcgagaatgtgcccgaggaggacgggacccgcttccacagacaggccagcaagtgtgacagtcat ggcacccacctggcaggggtggtcagcggccgggatgccggctggccaagggtgccagcatgcgcagcctgcgcgtgctcaactgccaaggg aagggcacggttagcggcacccctcataggcctggagtttattcggaaaagccagctggtccagcctgtggggccactggtggtgctgctgcccct ggcggggtgggtacagccgcgtcctcaacgccgcctgccagcgcctggcgagggctggggtcgtgctggtcaccgctgccggcaacttccgggac gatgcctgcctctactccccagcctcagctcccgaggtcatcacagttgggccaccaatgcccaagaccagccggtgaccctggggactttggg* | 28 |

TABLE 6-continued

PCSK9 SEQUENCES

| FORM/ ALLELE | VERSION | SEQUENCE | SEQ ID NO: |
|---|---|---|---|
| | | gaccaactttggccgctgtgtggacctctttgccccaggggaggacatcattggtgcctccagcgactgcagcacctgctttgtgtcacagagtgg<br>gacatcacaggctgctgcccacgtggctggcattgcagccatgatgctgtctgccgagccggagctcaccctggccgagttgaggcagagactg<br>            N425S AAT to AGT                         A443T GCC to ACC<br>atccacttctctgccaaagatgtcatc<u>aat</u>gaggcctggttccctgaggaccagcgggtactgacccccaacctggtggccg<u>cc</u>ctgccccccag<br>cacccatGGGGCAGGTTGGCAGCTGTTTTGCAGGACTGTATGGTCAGCACACTCGGGGCCTACACGGATGGCC<br>    I474V ATC to GTC<br>ACAGCC<u>ATC</u>GCCCGCTGCGCCCCAGATGAGGAGCTGCTGAGCTGCTCCAGTTTCTCCAGGAGTGGGAAGCGG<br>CGGGGCGAGCGCATGGAGGCCCAAGGGGGCAAGCTGGTCTGCCGGGCCCACAACGCTTTTGGGGGTGAGGG<br>TGTCTACGCCATTGCCAGGTGCTGCCTGCTACCCCAGGCCAACTGCAGCGTCCACACAGCTCCACCAGCTGAG<br>GCCAGCATGGGGACCCGTGTCCACTGCCACCAACAGGGCCACGTCCTCACAGGCTGCAGCTCCCACTGGGAG<br>GTGGAGGACCTTGGCACCCACAAGCCGCTGTGCTGAGGCCACGAGGTCAGCCCAACCAGTGCGTGGGCCAC<br>AGGGAGGCCAGCATCCACGCTTCCTGCTGCCATGCCCCAGGTCTGGAATGCAAAGTCAAGGAGCATGGAA<br>    Q619P CAG to CCG E620G GAG to GGG<br>TCCCGGCCCCT<u>CAGGAG</u>CAGGTGACCGTGGCCTGCGAGGAGGGCTGGACCCTGACTGGCTGCAGTGCCCTCC<br>CTGGGACCTCCCACGTCCTGGGGGCCTACGCCGTAGACAACACGTGTGTAGTCAGGAGCCGGGACGTCAGCA<br>            E570G GAG to GGG<br>CTACAGGCAGCACCAGCGAA<u>GAG</u>GCCGTGACAGCCGTTGCCATCTGCTGCCGGAGCCGGCACCTGGCGCAGG<br>CCTCCCAGGAGCTCCAGTGAC | |
| f | | *ATGGGCACCGTCAGCTCCAGGCGGTCCTGGTGGCCGCTGCCACTGCTGCTGCTGCTGCTGCTCCTGGGTC*<br>                                         R46LCGT to CTT<br>*CCGCGGGCGCCCGTGCG*CAGGAGGACGAGGACGGCGACTACGAGGAGCTGGTGCTAGCCTTG<u>C</u>G<u>TT</u>CCG<br>       A53VGCC to GTC<br>AGGAGGACGGCCTGG<u>GCC</u>GAAGCACCCGAGCACGGAACCACAGCCACCTTCCACCGCTGCGCCAAGGAT<br><br>CCGTGGAGGTTGCCTGGCACCTACGTGGTGGTGCTGAAGGAGGAGACCCACCTCTCGCAGTCAGAGCG<br><br>CACTGCCCGCCGCCTGCAGGCCCAGGCTGCCCGCCGGGGATACCTCACCAAGATCCTGCATGTCTTCC<br><br>ATGGCCTTCTTCCTGGCTTCCTGGTGAAGATGAGTGGCGACCTGCTGGAGCTGGCCTTGAAGTTGCCC<br><br>CATGTCGACTACATCGAGGAGGACTCCTCTGTCTTTGCCCAGagcatcccgtggaacctggagcggattacccctcca<br><br>cggtaccgggcggatgaataccagcccccgacggaggcagcctggtggaggtgtatctcctagacaccagcatacagagtgaccaccgggaa<br>atcgagggcagggtcatggtcaccgacttcgagaatgtgcccgaggaggacgggacccgcttccacagacaggccagcaagtgtgacagtcat<br>ggcacccacctggcaggggtggtcagcggccgggatgccggcgtggccaagggtgccagcatgcgcagcctgcgcgtgctcaactgccaaggg<br>aagggcacggttagcggcaccctcataggcctggagtttattcggaaaagccagctggtccagcctgtggggccactggtggtgctgctgcccct<br>ggcgggtgggtacagccgcgtcctcaacgccgcctgccagcgcctggcgagggctggggtcgtgctggtcaccgctgccggcaacttccgggac<br>gatgcctgcctctactccccagcctcagctcccgaggtcatcacagttggggcaccaatgcccaagaccagccggtgaccctggggactttggg<br>gaccaactttggccgctgtgtggacctctttgccccaggggaggacatcattggtgcctccagcgactgcagcacctgctttgtgtcacagagtgg<br>gacatcacaggctgctgcccacgtggctggcattgcagccatgatgctgtctgccgagccggagctcaccctggccgagttgaggcagagactg<br>            N425S AAT to AGT                         A443T GCC to ACC<br>atccacttctctgccaaagatgtcatc<u>aat</u>gaggcctggttccctgaggaccagcgggtactgaccccaacctggtggccg<u>cc</u>ctgccccccag<br>cacccatGGGGCAGGTTGGCAGCTGTTTTGCAGGACTGTATGGTCAGCACACTCGGGGCCTACACGGATGGCC<br>    I474V ATC to GTC<br>ACAGCCGTCGCCCGCTGCGCCCCAGATGAGGAGCTGCTGAGCTGCTCCAGTTTCTCCAGGAGTGGGAAGCGG<br>CGGGGCGAGCGCATGGAGGCCCAAGGGGGCAAGCTGGTCTGCCGGGCCCACAACGCTTTTGGGGGTGAGGG<br>TGTCTACGCCATTGCCAGGTGCTGCCTGCTACCCCAGGCCAACTGCAGCGTCCACACAGCTCCACCAGCTGAG<br>GCCAGCATGGGGACCCGTGTCCACTGCCACCAACAGGGCCACGTCCTCACAGGCTGCAGCTCCCACTGGGAG<br>GTGGAGGACCTTGGCACCCACAAGCCGCTGTGCTGAGGCCACGAGGTCAGCCCAACCAGTGCGTGGGCCAC<br>AGGGAGGCCAGCATCCACGCTTCCTGCTGCCATGCCCCAGGTCTGGAATGCAAAGTCAAGGAGCATGGAA<br>    Q619P CAG to CCG E620G GAG to GGG<br>TCCCGGCCCCT<u>CAGGAG</u>CAGGTGACCGTGGCCTGCGAGGAGGGCTGGACCCTGACTGGCTGCAGTGCCCTCC<br>CTGGGACCTCCCACGTCCTGGGGGCCTACGCCGTAGACAACACGTGTGTAGTCAGGAGCCGGGACGTCAGCA<br>            E670G GAG to GGG<br>CTACAGGCAGCACCAGCGAA<u>GAG</u>GCCGTGACAGCCGTTGCCATCTGCTGCCGGAGCCGGCACCTGGCGCAGG<br>CCTCCCAGGAGCTCCAGTGAC | 29 |
| c | | *ATGGGCACCGTCAGCTCCAGGCGGTCCTGGTGGCCGCTGCCACTGCTGCTGCTGCTGCTGCTCCTGGGTC*<br>                                         R46LCGT to CTT<br>*CCGCGGGCGCCCGTGCG*CAGGAGGACGAGGACGGCGACTACGAGGAGCTGGTGCTAGCCTTG<u>C</u>G<u>TT</u>CCG<br>       A53VGCC to GTC<br>AGGAGGACGGCCTGG<u>GCC</u>GAAGCACCCGAGCACGGAACCACAGCCACCTTCCACCGCTGCGCCAAGGAT<br><br>CCGTGGAGGTTGCCTGGCACCTACGTGGTGGTGCTGAAGGAGGAGACCCACCTCTCGCAGTCAGAGCG<br><br>CACTGCCCGCCGCCTGCAGGCCCAGGCTGCCCGCCGGGGATACCTCACCAAGATCCTGCATGTCTTCC<br><br>ATGGCCTTCTTCCTGGCTTCCTGGTGAAGATGAGTGGCGACCTGCTGGAGCTGGCCTTGAAGTTGCCC<br><br>CATGTCGACTACATCGAGGAGGACTCCTCTGTCTTTGCCCAGagcatcccgtggaacctggagcggattacccctcca<br><br>cggtaccgggcggatgaataccagcccccgacggaggcagcctggtggaggtgtatctcctagacaccagcatacagagtgaccaccgggaa | 30 |

TABLE 6-continued

PCSK9 SEQUENCES

| FORM/ALLELE | VERSION | SEQUENCE | SEQ ID NO: |
|---|---|---|---|
| | | atcgagggcagggtcatggtcaccgacttcgagaatgtgcccgaggaggacgggacccgcttccacagacaggccagcaagtgtgacagtcat<br>ggcacccacctggcaggggtggtcagcggccgggatgccggcgtggccaagggtgccagcatgcgcagcctgcgcgtgctcaactgccaaggg<br>aagggcacggttagcggcaccctcataggcctggagtttattcggaaaagccagctggtccagcctgtggggccactggtggtgctgctgcccct<br>ggcgggtgggtacagccgcgtcctcaacgccgcctgccagcgcctggcgagggctggggtcgtgctggtcaccgctgccggcaacttccgggac<br>gatgcctgcctctactccccagcctcagctcccgaggtcatcacagttggggccaccaatgcccaagaccagccggtgaccctggggactttggg<br>gaccaactttggccgctgtgtggacctctttgccccaggggaggacatcattggtgcctccagcgactgcagcacctgctttgtgtcacagagtgg<br>gacatcacaggctgctgcccacgtggctggcattgcagccatgatgctgtctgccgagccggagctcaccctggccgagttgaggcagagactg |  |
| | | N425S AAT to AGT            A443T GCC to ACC<br>atccacttctctgccaaagatgtcatc<u>a</u>atgaggcctggttccctgaggaccagcgggtactgaccccaacctggtggcc<u>g</u>ccctgcccccag<br>cacccatGGGGCAGGTTGGCAGCTGTTTTGCAGGACTGTATGGTCAGCACACTCGGGGCCTACACGGATGGCC<br>    I474V ATC to GTC<br>ACAGCC<u>ATC</u>GCCCGCTGCGCCCCAGATGAGGAGCTGCTGAGCTGCTGCCAGTTTCTCCAGGAGTGGGAAGCGG<br>CGGGGCGAGCGCATGGAGGCCCAAGGGGGCAAGCTGGTCTGCCGGGCCCACAACGCTTTTGGGGGTGAGGG<br>TGTCTACGCCATTGCCAGGTGCTGCCTGCTACCCCAGGCCAACTGCAGCGTCCACACAGCTCCACCAGCTGAG<br>GCCAGCATGGGGACCCGTGTCCACTGCCACCAACAGGGCCACGTCCTCACAGGCTGCAGCTCCCACTGGGAG<br>GTGGAGGACCTTGGCACCCACAAGCCGCCTGTGCTGAGGCCACGAGGTCAGCCCAACCAGTGCGTGGGCCAC<br>AGGGAGGCCAGCATCCACGCTTCCTGCTGCCATGCCCCAGGTCTGGAATGCAAAGTCAAGGAGCATGGAA<br>    Q619P CAG to CCG     E620G GAG to GGG<br>TCCCGGCCCCT<u>CAGGAG</u>CAGGTGACCGTGGCCTGCGAGGAGGGCTGGACCCTGACTGGCTGCAGTGCCCTCC<br>CTGGGACCTCCCACGTCCTGGGGGCCTACGCCGTAGACAACACGTGTGTAGTCAGGAGCCGGGACGTCAGCA<br>    E670GGAG to GGG<br>CTACAGGCAGCACCAGCGAA<u>GGG</u>GCCGTGACAGCCGTTGCCATCTGCTGCCGGAGCCGGCACCTGGCGCAGG<br>CCTCCCAGGAGCTCCAGTGAC |  |
| r | | *ATGGGCACCGTCAGCTCCAGGCGGTCCTGGTGGCCGCTGCCACTGCTGCTGCTGCTGCTGCTCCTGGGTC*<br>                                                                                       R46LCGT to CTT<br>*CCGCGGGCGCCCGTGCG* CAGGAGGACGAGGACGGCGACTACGAGGAGCTGGTGCTAGCCTTG<u>C</u>GTTCCG<br>    A53VGCC to GTC<br>AGGAGGACGGCCTG<u>GCC</u>GAAGCACCCGAGCACGGAACCACAGCCACCTTCCACCGCTGCGCCAAGGAT<br>CCGTGGAGGTTGCCTGGCACCTACGTGGTGGTGCTGAAGGAGGAGACCCACCTCTCGCAGTCAGAGCG<br>CACTGCCCGCCGCCTGCAGGCCCAGGCTGCCCGCCGGGGATACCTCACCAAGATCCTGCATGTCTTCC<br>ATGGCCTTCTTCCTGGCTTCCTGGTGAAGATGAGTGGCGACCTGCTGGAGCTGGCCTTGAAGTTGCCC<br>CATGTCGACTACATCGAGGAGGACTCCTCTGTCTTTGCCCAGagcatcccgtggaacctggagcggattacccctcca<br>cggtaccgggcggatgaataccagcccccgacggaggcagcctggtggaggtgtatctcctagacaccagcatacagagtgaccaccgggaa<br>atcgagggcagggtcatggtcaccgacttcgagaatgtgcccgaggaggacgggacccgcttccacagacaggccagcaagtgtgacagtcat<br>ggcacccacctggcaggggtggtcagcggccgggatgccggcgtggccaagggtgccagcatgcgcagcctgcgcgtgctcaactgccaaggg<br>aagggcacggttagcggcaccctcataggcctggagtttattcggaaaagccagctggtccagcctgtggggccactggtggtgctgctgcccct<br>ggcgggtgggtacagccgcgtcctcaacgccgcctgccagcgcctggcgagggctggggtcgtgctggtcaccgctgccggcaacttccgggac<br>gatgcctgcctctactccccagcctcagctcccgaggtcatcacagttggggccaccaatgcccaagaccagccggtgaccctggggactttggg<br>gaccaactttggccgctgtgtggacctctttgccccaggggaggacatcattggtgcctccagcgactgcagcacctgctttgtgtcacagagtgg<br>gacatcacaggctgctgcccacgtggctggcattgcagccatgatgctgtctgccgagccggagctcaccctggccgagttgaggcagagactg<br>    N425S AAT to AGT                     A443T GCC to ACC<br>atccacttctctgccaaagatgtcatc<u>a</u>atgaggcctggttccctgaggaccagcgggtactgaccccaacctggtggcc<u>g</u>ccctgcccccag<br>cacccatGGGGCAGGTTGGCAGCTGTTTTGCAGGACTGTATGGTCAGCACACTCGGGGCCTACACGGATGGCC<br>    I474V ATC to GTC<br>ACAGCC<u>GTC</u>GCCCGCTGCGCCCCAGATGAGGAGCTGCTGAGCTGCTCCAGTTTCTCCAGGAGTGGGAAGCGG<br>CGGGGCGAGCGCATGGAGGCCCAAGGGGGCAAGCTGGTCTGCCGGGCCCACAACGCTTTTGGGGGTGAGGG<br>TGTCTACGCCATTGCCAGGTGCTGCCTGCTACCCCAGGCCAACTGCAGCGTCCACACAGCTCCACCAGCTGAG<br>GCCAGCATGGGGACCCGTGTCCACTGCCACCAACAGGGCCACGTCCTCACAGGCTGCAGCTCCCACTGGGAG<br>GTGGAGGACCTTGGCACCCACAAGCCGCCTGTGCTGAGGCCACGAGGTCAGCCCAACCAGTGCGTGGGCCAC<br>AGGGAGGCCAGCATCCACGCTTCCTGCTGCCATGCCCCAGGTCTGGAATGCAAAGTCAAGGAGCATGGAA<br>    Q619P CAG to CCG     E520G GAG to GGG<br>TCCCGGCCCCT<u>CAGGAG</u>CAGGTGACCGTGGCCTGCGAGGAGGGCTGGACCCTGACTGGCTGCAGTGCCCTCC<br>CTGGGACCTCCCACGTCCTGGGGGCCTACGCCGTAGACAACACGTGTGTAGTCAGGAGCCGGGACGTCAGCA<br>    E670G GAG to GGG<br>CTACAGGCAGCACCAGCGAA<u>GGG</u>GCCGTGACAGCCGTTGCCATCTGCTGCCGGAGCCGGCACCTGGCGCAGG<br>CCTCCCAGGAGCTCCAGTGAC | 31 |
| p | | *ATGGGCACCGTCAGCTCCAGGCGGTCCTGGTGGCCGCTGCCACTGCTGCTGCTGCTGCTGCTCCTGGGTC*<br>                                                                                       R46L CGT to CTT<br>*CCGCGGGCGCCCGTGCG* CAGGAGGACGAGGACGGCGACTACGAGGAGCTGGTGCTAGCCTTG<u>C</u>GTTCCG<br>    AS3VGCC to GTC<br>AGGAGGACGGCCTG<u>GT</u>CGAAGCACCCGAGCACGGAACCACAGCCACCTTCCACCGCTGCGCCAAGGAT<br>CCGTGGAGGTTGCCTGGCACCTACGTGGTGGTGCTGAAGGAGGAGACCCACCTCTCGCAGTCAGAGCG | 32 |

TABLE 6-continued

PCSK9 SEQUENCES

| FORM/ ALLELE | VERSION | SEQUENCE | SEQ ID NO: |
|---|---|---|---|
| | | CACTGCCCGCCGCCTGCAGGCCCAGGCTGCCCGCCGGGGATACCTCACCAAGATCCTGCATGTCTTCC<br>ATGGCCTTCTTCCTGGCTTCCTGGTGAAGATGAGTGGCGACCTGCTGGAGCTGGCCTTGAAGTTGCCC<br>CATGTCGACTACATCGAGGAGGACTCCTCTGTCTTTGCCCAGagcatcccgtggaacctggagcggattacccctcca<br>cggtaccgggcggatgaataccagcccccgacggaggcagcctggtggaggtgtatctcctagacaccagcatacagagtgaccaccgggaa<br>atcgagggcagggtcatggtcaccgacttcgagaatgtgcccgaggaggacgggacccgcttccacagacaggccagcaagtgtgacagtcat<br>ggcacccacctggcaggggtggtcagcggccgggatgccggcgtggccaagggtgccagcatgcgcagcctgcgcgtgctcaactgccaaggg<br>aagggcacggttagcggcaccctcataggcctggagtttattcggaaaagccagctggtccagcctgtggggccactggtggtgctgctgccccct<br>ggcgggtgggtacagccgcgtcctcaacgccgcctgccagccgcctggcgagggctggggtcgtgctggtcaccgctgccggcaacttccgggac<br>gatgcctgcctctactcccagcctcagctcccgaggtcatcacagttgggggccaccaatgcccaagaccagccggtgaccctggggactttggg<br>gaccaactttggccgctgtgtggacctctttgccccaggggaggacatcattggtgcctccagcgactgcagcacctgctttgtgtcacagagtgg<br>gacatcacaggctgctgcccacgtggctggcattgcagccatgatgctgtctgccgagccggagctcaccctggccgagttgaggcagagactg<br>                        N425S AAT to AGT                                                                   A443T GCC to ACC<br>atccacttctctgccaaagatgtcatc<u>aat</u>gaggcctggttccctgaggaccagcgggtactgaccccccaacctggtggcc<u>gcc</u>tgccccccag<br>cacccat GGGGCAGGTTGGCAGCTGTTTTGCAGGACTGTATGGTCAGCACACTCGGGGCCTACACGGATGGCC<br>    I474V ATC to GTC<br>ACAGCCGTCGCCCCGCTGCGCCCCAGATGAGGAGCTGCTGAGCTGCTCCAGTTTCTCCAGGAGTGGGAAGCGG<br>CGGGGCGAGCGCATGGAGGCCCAAGGGGGCAAGCTGGTCTGCCGGGCCCACAACGCTTTTGGGGGTGAGGG<br>TGTCTACGCCATTGCCAGGTGCTGCCTGCTACCCCAGGCCAACTGCAGCGTCCACACAGCTCCACCAGCTGAG<br>GCCAGCATGGGGACCCGTGTCCACTGCCACCAACAGGGCCACGTCCTCACAGGCTGCAGCTCCCACTGGGAG<br>GTGGAGGACCTTGGCACCCACAAGCCGCCTGTGCTGAGGCCACGAGGTCAGCCCAACCAGTGCGTGGGCCAC<br>AGGGAGGCCAGCATCCACGCTTCCTGCTGCCATGCCCCAGGTCTGGAATGCAAAGTCAAGGAGCATGGAA<br>       Q619P CAG to CCG E620G GAG to GGG<br>TCCCGGCCCCT<u>CAGGAG</u>CAGGTGACCGTGGCCTGCGAGGAGGGCTGGACCCTGACTGGCTGCAGTGCCCTCC<br>CTGGGACCTCCCACGTCCTGGGGGCCTACGCCGTAGACAACACGTGTGTAGTCAGGAGCCGGGACGTCAGCA<br>          E570G GAG to GGG<br>CTACAGGCAGCACCAGCGAA<u>GAG</u>GCCGTGACAGCCGTTGCCATCTGCTGCCGGAGCCGGCACCTGGCGCAGG<br>CCTCCCAGGAGCTCCAGTGAC | |
| m | | *ATGGGCACCGTCAGCTCCAGGCGGTCCTGGTGGCCGCTGCCACTGCTGCTGCTGCTGCTGCTCCTGGGTC*<br>                                                                               R46L CGT to CTT<br>*CCGCGGGCGCCCGTGCG* CAGGAGGACGAGGACGGCGACTACGAGGAGCTGGTGCTAGCCTTG<u>C</u>GTTCCG<br>    A45V GCC to GTC<br>AGGAGGACGGCCTGGCCGAAGCACCCGAGCACGGAACCACAGCCACCTTCCACCGCTGCGCCAAGGAT<br>CCGTGGAGGTTGCCTGGCACCTACGTGGTGGTGCTGAAGGAGGAGACCCACCTCTCGCAGTCAGAGCG<br>CACTGCCCGCCGCCTGCAGGCCCAGGCTGCCCGCCGGGGATACCTCACCAAGATCCTGCATGTCTTCC<br>ATGGCCTTCTTCCTGGCTTCCTGGTGAAGATGAGTGGCGACCTGCTGGAGCTGGCCTTGAAGTTGCCC<br>CATGTCGACTACATCGAGGAGGACTCCTCTGTCTTTGCCCAGagcatcccgtggaacctggagcggattacccctcca<br>cggtaccgggcggatgaataccagcccccgacggaggcagcctggtggaggtgtatctcctagacaccagcatacagagtgaccaccgggaa<br>atcgagggcagggtcatggtcaccgacttcgagaatgtgcccgaggaggacgggacccgcttccacagacaggccagcaagtgtgacagtcat<br>ggcacccacctggcaggggtggtcagcggccgggatgccggcgtggccaagggtgccagcatgcgcagcctgcgcgtgctcaactgccaaggg<br>aagggcacggttagcggcaccctcataggcctggagtttattcggaaaagccagctggtccagcctgtggggccactggtggtgctgctgccccct<br>ggcgggtgggtacagccgcgtcctcaacgccgcctgccagccgcctggcgagggctggggtcgtgctggtcaccgctgccggcaacttccgggac<br>gatgcctgcctctactcccagcctcagctcccgaggtcatcacagttgggggccaccaatgcccaagaccagccggtgaccctggggactttggg<br>gaccaactttggccgctgtgtggacctctttgccccaggggaggacatcattggtgcctccagcgactgcagcacctgctttgtgtcacagagtgg<br>gacatcacaggctgctgcccacgtggctggcattgcagccatgatgctgtctgccgagccggagctcaccctggccgagttgaggcagagactg<br>                        N425S AAT to AGT                                          A443T GCC to ACC<br>atccacttctctgccaaagatgtcatc<u>aat</u>gaggcctggttccctgaggaccagcgggtactgaccccccaacctggtggcc<u>acc</u>tgccccccag<br>cacccat GGGGCAGGTTGGCAGCTGTTTTGCAGGACTGTATGGTCAGCACACTCGGGGCCTACACGGATGGCC<br>    I474V ATC to GTC<br>ACAGCC<u>ATC</u>GCCCCGCTGCGCCCCAGATGAGGAGCTGCTGAGCTGCTCCAGTTTCTCCAGGAGTGGGAAGCGG<br>CGGGGCGAGCGCATGGAGGCCCAAGGGGGCAAGCTGGTCTGCCGGGCCCACAACGCTTTTGGGGGTGAGGG<br>TGTCTACGCCATTGCCAGGTGCTGCCTGCTACCCCAGGCCAACTGCAGCGTCCACACAGCTCCACCAGCTGAG<br>GCCAGCATGGGGACCCGTGTCCACTGCCACCAACAGGGCCACGTCCTCACAGGCTGCAGCTCCCACTGGGAG<br>GTGGAGGACCTTGGCACCCACAAGCCGCCTGTGCTGAGGCCACGAGGTCAGCCCAACCAGTGCGTGGGCCAC<br>AGGGAGGCCAGCATCCACGCTTCCTGCTGCCATGCCCCAGGTCTGGAATGCAAAGTCAAGGAGCATGGAA<br>       Q619P CAG to CCG E620G GAG to GGG<br>TCCCGGCCCCT<u>CAGGAG</u>CAGGTGACCGTGGCCTGCGAGGAGGGCTGGACCCTGACTGGCTGCAGTGCCCTCC<br>CTGGGACCTCCCACGTCCTGGGGGCCTACGCCGTAGACAACACGTGTGTAGTCAGGAGCCGGGACGTCAGCA<br>          E670G GAG to GGG<br>CTACAGGCAGCACCAGCGAA<u>GAG</u>GCCGTGACAGCCGTTGCCATCTGCTGCCGGAGCCGGCACCTGGCGCAGG<br>CCTCCCAGGAGCTCCAGTGAC | 33 |

TABLE 6-continued

PCSK9 SEQUENCES

| FORM/ALLELE | VERSION | SEQUENCE | SEQ ID NO: |
|---|---|---|---|
| e | | *ATGGGCACCGTCAGCTCCAGGCGGTCCTGGTGGCCGCTGCCACTGCTGCTGCTGCTGCTGCTCCTGGGTC* <br>                            R46L CGT to CTT <br> *CCGCGGGCGCCCGTGCG*CAGGAGGACGAGGACGGCGACTACGAGGAGCTGGTGCTAGCCTTG<u>C</u>GTTCCG <br>       A53V GCC to GTC <br> AGGAGGACGGCCTGG<u>CC</u>GAAGCACCCGAGCACGGAACCACAGCCACCTTCCACCGCTGCGCCAAGGAT <br> CCGTGGAGGTTGCCTGGCACCTACGTGGTGGTGCTGAAGGAGGAGACCCACCTCTCGCAGTCAGAGCG <br> CACTGCCCGCCGCCTGCAGGCCCAGGCTGCCCGCCGGGGATACCTCACCAAGATCCTGCATGTCTTCC <br> ATGGCCTTCTTCCTGGCTTCCTGGTGAAGATGAGTGGCGACCTGCTGGAGCTGGCCTTGAAGTTGCCC <br> CATGTCGACTACATCGAGGAGGACTCCTCTGTCTTTGCCCAGagcatcccgtggaacctggagcggattaccccctcca <br> cggtaccgggcggatgaataccagcccccgacggaggcagcctggtggaggtgtatctcctagacaccagcatacagagtgaccaccgggaa <br> atcgagggcagggtcatggtcaccgacttcgagaatgtgcccgaggaggacgggacccgcttccacagacaggccagcaagtgtgacagtcat <br> ggcacccacctggcaggggtggtcagcggccgggatgccggcctggccaagggtgccagcatgcgcagcctgcgcgtgctcaactgccaaggg <br> aagggcacggttagcggcaccctcataggcctggagtttattcggaaaagccagctggtccagcctgtggggcactggtggtgctgctgcccct <br> ggcgggtgggtacagccgcgtcctcaacgccgcctgccagcgcctggcgagggctgggtcgtgctggtcaccgctgccggcaacttccgggac <br> gatgcctgcctctactccccagcctcagctcccgaggtcatcacagttggggccaccaatgcccaagaccagccggtgaccctggggactttggg <br> gaccaacttttggccgctgtgtggacctctttgccccaggggaggacatcattggtgcctccagcgactgcagcacctgctttgtgtcacagagtgg <br> gacatcacaggctgctgcccacgtggctggcattgcagccatgatgctgtctgccgagccggagctcaccctggccgagttgaggcagagactg <br>         N425S AAT to AGT            A443T GCC to ACC <br> atccacttctctgccaaagatgtcatc<u>agt</u>gaggcctggttccctgaggaccagcgggtactgaccccaacctggtggcc<u>g</u>ccctgccccccag <br> cacccatGGGGCAGGTTGGCAGCTGTTTTGCAGGACTGTATGGTCAGCACACTCGGGGCCTACACGGATGGCC <br>   I474V ATC to GTC <br> ACAGCC<u>GTC</u>GCCCGCTGCGCCCCAGATGAGGAGCTGCTGAGCTGCTCCAGTTTCTCCAGGAGTGGGAAGCGG <br> CGGGGCGAGCGCATGGAGGCCCAAGGGGGCAAGCTGGTCTGCCGGGCCCACAACGCTTTTGGGGGTGAGGG <br> TGTCTACGCCATTGCCAGGTGCTGCCTGCTACCCCAGGCCAACTGCAGCGTCCACACAGCTCCACCAGCTGAG <br> GCCAGCATGGGGACCCGTGTCCACTGCCACCAACAGGGCCACGTCCTCACAGGCTGCAGCTCCCACTGGGAG <br> GTGGAGGACCTTGGCACCCACAAGCCGCCTGTGCTGAGGCCACGAGGTCAGCCCAACCAGTGCGTGGGCCAC <br> AGGGAGGCCAGCATCCACGCTTCCTGCTGCCATGCCCCAGGTCTGGAATGCAAAGTCAAGGAGCATGGAA <br>      Q619P CAG to CCG  E620G GAG to GGG <br> TCCCGGCCCCT<u>CAGGAG</u>CAGGTGACCGTGGCCTGCGAGGAGGGCTGGACCCTGACTGGCTGCAGTGCCCTCC <br> CTGGGACCTCCCACGTCCTGGGGGCCTACGCCGTAGACAACACGTGTGTAGTCAGGAGCCGGGACGTCAGCA <br>        E670G GAG to GGG <br> CTACAGGCAGCACCAGCGAAG<u>A</u>GGCCGTGACAGCCGTTGCCATCTGCTGCCGGAGCCGGCACCTGGCGCAGG <br> CCTCCCAGGAGCTCCAGTGAC | 34 |
| h | | *ATGGGCACCGTCAGCTCCAGGCGGTCCTGGTGGCCGCTGCCACTGCTGCTGCTGCTGCTGCTCCTGGGTC* <br>                            R46L CGT to CTT <br> *CCGCGGGCGCCCGTGCG* CAGGAGGACGAGGACGGCGACTACGAGGAGCTGGTGCTAGCCTTG<u>C</u>GTTCCG <br>       A53V GCC to GTC <br> AGGAGGACGGCCTGG<u>GCC</u>GAAGCACCCGAGCACGGAACCACAGCCACCTTCCACCGCTGCGCCAAGGAT <br> CCGTGGAGGTTGCCTGGCACCTACGTGGTGGTGCTGAAGGAGGAGACCCACCTCTCGCAGTCAGAGCG <br> CACTGCCCGCCGCCTGCAGGCCCAGGCTGCCCGCCGGGGATACCTCACCAAGATCCTGCATGTCTTCC <br> ATGGCCTTCTTCCTGGCTTCCTGGTGAAGATGAGTGGCGACCTGCTGGAGCTGGCCTTGAAGTTGCCC <br> CATGTCGACTACATCGAGGAGGACTCCTCTGTCTTTGCCCAGagcatcccgtggaacctggagcggattaccccctcca <br> cggtaccgggcggatgaataccagcccccgacggaggcagcctggtggaggtgtatctcctagacaccagcatacagagtgaccaccgggaa <br> atcgagggcagggtcatggtcaccgacttcgagaatgtgcccgaggaggacgggacccgcttccacagacaggccagcaagtgtgacagtcat <br> ggcacccacctggcaggggtggtcagcggccgggatgccggcctggccaagggtgccagcatgcgcagcctgcgcgtgctcaactgccaaggg <br> aagggcacggttagcggcaccctcataggcctggagtttattcggaaaagccagctggtccagcctgtggggcactggtggtgctgctgcccct <br> ggcgggtgggtacagccgcgtcctcaacgccgcctgccagcgcctggcgagggctgggtcgtgctggtcaccgctgccggcaacttccgggac <br> gatgcctgcctctactccccagcctcagctcccgaggtcatcacagttggggccaccaatgcccaagaccagccggtgaccctggggactttggg <br> gaccaacttttggccgctgtgtggacctctttgccccaggggaggacatcattggtgcctccagcgactgcagcacctgctttgtgtcacagagtgg <br> gacatcacaggctgctgcccacgtggctggcattgcagccatgatgctgtctgccgagccggagctcaccctggccgagttgaggcagagactg <br>        N425S AAT to AGT           A443T GCC to ACC <br> atccacttctctgccaaagatgtcatc<u>aat</u>gaggcctggttccctgaggaccagcgggtactgaccccaacctggtggcc<u>acc</u>ctgccccccag <br> cacccatGGGGCAGGTTGGCAGCTGTTTTGCAGGACTGTATGGTCAGCACACTCGGGGCCTACACGGATGGCC <br>   I474V ATC to GTC <br> ACAGCC<u>ATC</u>GCCCGCTGCGCCCCAGATGAGGAGCTGCTGAGCTGCTCCAGTTTCTCCAGGAGTGGGAAGCGG <br> CGGGGCGAGCGCATGGAGGCCCAAGGGGGCAAGCTGGTCTGCCGGGCCCACAACGCTTTTGGGGGTGAGGG <br> TGTCTACGCCATTGCCAGGTGCTGCCTGCTACCCCAGGCCAACTGCAGCGTCCACACAGCTCCACCAGCTGAG <br> GCCAGCATGGGGACCCGTGTCCACTGCCACCAACAGGGCCACGTCCTCACAGGCTGCAGCTCCCACTGGGAG <br> GTGGAGGACCTTGGCACCCACAAGCCGCCTGTGCTGAGGCCACGAGGTCAGCCCAACCAGTGCGTGGGCCAC <br> AGGGAGGCCAGCATCCACGCTTCCTGCTGCCATGCCCCAGGTCTGGAATGCAAAGTCAAGGAGCATGGAA | 35 |

TABLE 6-continued

PCSK9 SEQUENCES

| FORM/ALLELE | VERSION | SEQUENCE | SEQ ID NO: |
|---|---|---|---|
| | | Q519P CAG to CCG E620G GAG to GGG<br>TCCCGGCCCCTCCGGAGCAGGTGACCGTGGCCTGCGAGGAGGGCTGGACCCTGACTGGCTGCAGTGCCCTCC<br>CTGGGACCTCCCACGTCCTGGGGGCCTACGCCGTAGACAACACGTGTGTAGTCAGGAGCCGGGACGTCAGCA<br>E670G GAG to GGG<br>CTACAGGCAGCACCAGCGAAGAGGCCGTGACAGCCGTTGCCATCTGCTGCCGGAGCCGGCACCTGGCGCAGG<br>CCTCCCAGGAGCTCCAGTGAC | |
| aj | | *ATGGGCACCGTCAGCTCCAGGCGGTCCTGGTGGCCGCTGCCACTGCTGCTGCTGCTGCTGCTGCTCCTGGGTC*<br>R46L CGT to CTT<br>*CCGCGGGCGCCCGTGCG* CAGGAGGACGAGGACGGCGACTACGAGGAGCTGGTGCTAGCCTTGCTTTCCG<br>A53V GCC to GTC<br>AGGAGGACGGCCTGGCCGAAGCACCCGAGCACGGAACCACAGCCACCTTCCACCGCTGCGCCAAGGAT<br>CCGTGGAGGTTGCCTGGCACCTACGTGGTGGTGCTGAAGGAGGAGACCCACCTCTCGCAGTCAGAGCG<br>CACTGCCCGCCGCCTGCAGGCCCAGGCTGCCCGCCGGGGATACCTCACCAAGATCCTGCATGTCTTCC<br>ATGGCCTTCTTCCTGGCTTCCTGGTGAAGATGAGTGGCGACCTGCTGGAGCTGGCCTTGAAGTTGCCC<br>CATGTCGACTACATCGAGGAGGACTCCTCTGTCTTTGCCCAGagcatcccgtggaacctggagcggattacccctcca<br>cggtaccgggcggatgaataccagcccccgacggaggcagcctggtggaggtgtatctcctagacaccagcatacagagtgaccaccgggaa<br>atcgagggcagggtcatggtcaccgacttcgagaatgtgcccgaggaggacgggacccgcttccacagacaggccagcaagtgtgacagtcat<br>ggcacccacctggcagggggtggtcagcggcccgggatgccggcgtggccaagggtgccagcatgcgcagcctgcgcgtgctcaactgccaaggg<br>aagggcacggttagcggcaccctcataggcctggagtttattcggaaaagccagctggtccagcctgtggggccactggtggtgctgctgccct<br>ggcgggtgggtacagccgcgtcctcaacgccgcctgccagcgcctggcgagggctgggtcgtgctggtcaccgctgccggcaacttccgggac<br>gatgcctgcctctactccccagcctcagctcccgaggtcatcacagttggggccaccaatgcccaagaccagccggtgaccctgggactttggg<br>gaccaactttggccgctgtgtggacctctttgccccaggggaggacatcattggtgcctccagcgactgcagcacctgctttgtgtcacagagtgg<br>gacatcacaggctgctgcccacgtggctggcattgcagccatgatgctgtctgccgagccggagctcaccctggccgagttgaggcagagactg<br>N425S AAT to AGT                   A443T GCC to ACC<br>atccacttctctgccaaagatgtcatcaatgaggcctggttccctgaggaccagcgggtactgaccccccaacctggtggccgccctgccccccag<br>cacccatGGGGCAGGTTGGCAGCTGTTTTGCAGGACTGTATGGTCAGCACACTCGGGGCCTACACGGATGGCC<br>I474V ATC to GTC<br>ACAGCCGTCGCCCGCTGCGCCCCAGATGAGGAGCTGCTGAGCTGCTCCAGTTTCTCCAGGAGTGGGAAGCGG<br>CGGGGCGAGCGCATGGAGGCCCAAGGGGGCAAGCTGGTCTGCCGGGCCCACAACGCTTTTGGGGGTGAGGG<br>TGTCTACGCCATTGCCAGGTGCTGCCTGCTACCCCAGGCCAACTGCAGCGTCCACACAGCTCCACCAGCTGAG<br>GCCAGCATGGGGACCCGTGTCCACTGCCACCAACAGGGCCACGTCCTCACAGGCTGCAGCTCCCACTGGGAG<br>GTGGAGGACCTTGGCACCCACAAGCCGCCTGTGCTGAGGCCACGAGGTCAGCCCAACCAGTGCGTGGGCCAC<br>AGGGAGGCCAGCATCCACGCTTCCTGCTGCCATGCCCCAGGTCTGGAATGCAAAGTCAAGGAGCATGGAA<br>Q619P CAG to CCG E620G GAG to GGG<br>TCCCGGCCCCTCAGGAGCAGGTGACCGTGGCCTGCGAGGAGGGCTGGACCCTGACTGGCTGCAGTGCCCTCC<br>CTGGGACCTCCCACGTCCTGGGGGCCTACGCCGTAGACAACACGTGTGTAGTCAGGAGCCGGGACGTCAGCA<br>E670G GAG to GGG<br>CTACAGGCAGCACCAGCGAAGAGGCCGTGACAGCCGTTGCCATCTGCTGCCGGAGCCGGCACCTGGCGCAGG<br>CCTCCCAGGAGCTCCAGTGAC | 36 |
| q | | *ATGGGCACCGTCAGCTCCAGGCGGTCCTGGTGGCCGCTGCCACTGCTGCTGCTGCTGCTGCTGCTCCTGGGTC*<br>R46L CGT to CTT<br>*CCGCGGGCGCCCGTGCG*CAGGAGGACGAGGACGGCGACTACGAGGAGCTGGTGCTAGCCTTGCGTTCCG<br>A53V GCC to GTC<br>AGGAGGACGGCCTGGTCGAAGCACCCGAGCACGGAACCACAGCCACCTTCCACCGCTGCGCCAAGGAT<br>CCGTGGAGGTTGCCTGGCACCTACGTGGTGGTGCTGAAGGAGGAGACCCACCTCTCGCAGTCAGAGCG<br>CACTGCCCGCCGCCTGCAGGCCCAGGCTGCCCGCCGGGGATACCTCACCAAGATCCTGCATGTCTTCC<br>ATGGCCTTCTTCCTGGCTTCCTGGTGAAGATGAGTGGCGACCTGCTGGAGCTGGCCTTGAAGTTGCCC<br>CATGTCGACTACATCGAGGAGGACTCCTCTGTCTTTGCCCAGagcatcccgtggaacctggagcggattacccctcca<br>cggtaccgggcggatgaataccagcccccgacggaggcagcctggtggaggtgtatctcctagacaccagcatacagagtgaccaccgggaa<br>atcgagggcagggtcatggtcaccgacttcgagaatgtgcccgaggaggacgggacccgcttccacagacaggccagcaagtgtgacagtcat<br>ggcacccacctggcagggggtggtcagcggcccgggatgccggcgtggccaagggtgccagcatgcgcagcctgcgcgtgctcaactgccaaggg<br>aagggcacggttagcggcaccctcataggcctggagtttattcggaaaagccagctggtccagcctgtggggccactggtggtgctgctgccct<br>ggcgggtgggtacagccgcgtcctcaacgccgcctgccagcgcctggcgagggctgggtcgtgctggtcaccgctgccggcaacttccgggac<br>gatgcctgcctctactccccagcctcagctcccgaggtcatcacagttggggccaccaatgcccaagaccagccggtgaccctgggactttggg<br>gaccaactttggccgctgtgtggacctctttgccccaggggaggacatcattggtgcctccagcgactgcagcacctgctttgtgtcacagagtgg<br>gacatcacaggctgctgcccacgtggctggcattgcagccatgatgctgtctgccgagccggagctcaccctggccgagttgaggcagagactg<br>N425S AAT to AGT                   A443T GCC to ACC<br>atccacttctctgccaaagatgtcatcaatgaggcctggttccctgaggaccagcgggtactgaccccccaacctggtggccgccctgccccccag | 37 |

TABLE 6-continued

PCSK9 SEQUENCES

| FORM/ ALLELE | VERSION | SEQUENCE | SEQ ID NO: |
|---|---|---|---|
| | | cacccatGGGGCAGGTTGGCAGCTGTTTTGCAGGACTGTATGGTCAGCACACTCGGGGCCTACACGGATGGCC | |
| | I474V ATC to GTC | ACAGCCATCGCCCGCTGCGCCCCAGATGAGGAGCTGCTGAGCTGCTCCAGTTTCTCCAGGAGTGGGAAGCGG CGGGGCGAGCGCATGGAGGCCCAAGGGGGCAAGCTGGTCTGCCGGGCCCACAACGCTTTTGGGGGTGAGGG TGTCTACGCCATTGCCAGGTGCTGCCTGCTACCCCAGGCCAACTGCAGCGTCCACACAGCTCCACCAGCTGAG GCCAGCATGGGGACCCGTGTCCACTGCCACCAACAGGGCCACGTCCTCACAGGCTGCAGCTCCCACTGGGAG GTGGAGGACCTTGGCACCCACAAGCCGCCTGTGCTGAGGCCACGAGGTCAGCCCAACCAGTGCGTGGGCCAC AGGGAGGCCAGCATCCACGCTTCCTGCTGCCATGCCCCAGGTCTGGAATGCAAAGTCAAGGAGCATGGAA | |
| | Q619P CAG to CCG E620G GAG to GGG | TCCCGGCCCCTCAGGAGCAGGTGACCGTGGCCTGCGAGGAGGGCTGGACCCTGACTGGCTGCAGTGCCCTCC CTGGGACCTCCCACGTCCTGGGGGCCTACGCCGTAGACAACACGTGTGTAGTCAGGAGCCGGGACGTCAGCA | |
| | E670G GAG to GGG | CTACAGGCAGCACCAGCGAAGGGGCCGTGACAGCCGTTGCCATCTGCTGCCGGAGCCGGCACCTGGCGCAGG CCTCCCAGGAGCTCCAGTGAC | |

TABLE 7

Human VH3-23 Variant Alleles

| VH3-23 haplotype | Cumulative allele frequency | SNPs | | | |
|---|---|---|---|---|---|
| a (= VH3-23 * 04) | 0.0983 | rs56069819 | | | |
| d | 0.0087 | rs56069819 | rs61750837 | rs61752504 | |
| e | 0.0046 | rs56069819 | rs1064090 | rs1055799 | |
| j | 0.0009 | rs56069819 | rs1055799 | | |
| u | 0.0005 | rs56069819 | rs1064091 | | |
| s | 0.0005 | rs56069819 | rs1064091 | rs61752504 | rs61750837 |
| r | 0.0005 | rs56069819 | rs1064090 | | |
| TOTAL: | 0.114 | | | | |

TABLE 8

Exemplary anti-PCSK9 antibodies and/or antibody fragments

| SEQ ID NOs comprising an anti-PCSK9 monoclonal antibody or fragment thereof | Patent or patent Publication |
|---|---|
| Light chain complementary determining regions (CDRL) SEQ ID NO: 5, 7, 9, 10, 12, 13, 14, 15, 16, 17, 18, 19, 20, 21, 22, 23, 24, 26, 28, 30, 31, 32, 33, 35, 36, 37, 38, 39, 40, 42, 44, 46, 270, 271, 272, 273, 275, 277, 286, 287, 288, 297, 299, 301, 405, 407, 409, 411, 413, 415, 417, 421, 425, 429, 433, 437, 441, 445, 449, 453, 457, 461, 465, 469, 473, 477, 481, 485; Heavy chain complementary determining regions (CDRH) SEQ ID NO: 47, 48, 49, 50, 51, 52, 53, 54, 55, 56, 57, 58, 60, 61, 62, 64, 65, 67, 69, 71, 72, 74, 76, 77, 78, 79, 80, 81, 83, 85, 87, 89, 91, 278, 289, 290, 291, 292, 298, 300, 302, 401, 404, 406, 408, 410, 412, 414, 416, 419, 423, 427, 431, 435, 439, 443, 447, 451, 455, 459, 463, 467, 471, 475, 479, 483; | US20120020975A1 |
| CDRL SEQ ID NO: 5, 7, 9, 10, 12, 13, 15, 16, 17, 18, 19, 20, 21, 22, 23, 24, 26, 28, 30, 31, 32, 33, 35, 36, 37, 38, 39, 40, 42, 44, 46, 405, 407, 409, 411, 413, 415, 417, 465; CDRH SEQ ID NO: 47, 48, 49, 50, 51, 52, 53, 54, 55, 56, 57, 58, 60, 62, 64, 65, 67, 69, 71, 72, 74, 76, 77, 78, 79, 80, 81, 83, 85, 87, 89, 91, 404, 406, 408, 410, 412, 414, 416, 463; | US20120027765A1 |
| CDRL SEQ ID NO: 5, 7, 9, 10, 12, 13, 15, 16, 17, 18, 19, 20, 21, 22, 23, 24, 26, 28, 30, 31, 32, 33, 35, 36, 37, 38, 39, 40, 42, 44, 46, 405, 407, 409, 411, 413, 415, 417, 465; CDRH SEQ ID NO: 47, 48, 49, 50, 51, 52, 53, 54, 55, 56, 57, 58, 60, 62, 64, 65, 67, 69, 71, 72, 74, 76, 77, 78, 79, 80, 81, 83, 85, 87, 89, 91, 404, 406, 408, 410, 412, 414, 416, 463; | US8168762B2 |
| CDRL SEQ ID NO: 5, 7, 9, 10, 12, 13, 15, 16, 17, 18, 19, 20, 21, 22, 23, 24, 26, 28, 30, 31, 32, 33, 35, 36, 37, 38, 39, 40, 42, 44, 46, 222, 229, 238, 405, 407, 409, 411, 413, 415, 417; CDRH SEQ ID NO: 47, 48, 49, 50, 51, 52, 53, 54, 55, 56, 57, 58, 60, 62, 64, 65, 67, 69, 71, 72, 74, 76, 77, 78, 79, 80, 81, 83, 85, 87, 89, 91, 247, 256, 265, 404, 406, 408, 410, 412, 414, 416; | US20120020976A1 |
| CDRL SEQ ID NO: 5, 7, 9, 10, 12, 13, 15, 16, 17, 18, 19, 20, 21, 22, 23, 24, 26, 28, 30, 31, 32, 33, 35, 36, 37, 38, 39, 40, 42, 44, 46, 405, 407, 409, 411, 413, 415, 417, 465, 485; CDRH SEQ ID NO: 47, 48, 49, 50, 51, 52, 53, 54, 55, 56, 57, 58, 60, 62, 64, 65, 67, 69, 71, 72, 74, 76, 77, 78, 79, 80, 81, 83, 85, 87, 89, 91, 404, 406, 408, 410, 412, 414, 416, 459, 463, 483; | US20130085265A1 |
| CDRL SEQ ID NO: 5, 7, 9, 10, 12, 13, 15, 16, 17, 18, 19, 20, 21, 22, 23, 24, 26, 28, 30, 31, 32, 33, 35, 36, 37, 38, 39, 40, 42, 44, 46, 405, 407, 409, 411, 413, 415, 417, 461, 465, 485; CDRH SEQ ID NO: 47, 48, 49, 50, 51, 52, 53, 54, 55, 56, 57, 58, 60, 62, 64, 65, 67, 69, 71, 72, | US20130079501A1 |

TABLE 8-continued

Exemplary anti-PCSK9 antibodies and/or antibody fragments

| SEQ ID NOs comprising an anti-PCSK9 monoclonal antibody or fragment thereof | Patent or patent Publication |
|---|---|
| 74, 76, 77, 78, 79, 80, 81, 83, 85, 87, 89, 91, 404, 406, 408, 410, 412, 414, 416, 459, 463, 483; CDRL SEQ ID NO: 5, 7, 9, 10, 12, 13, 15, 16, 17, 18, 19, 20, 21, 22, 23, 24, 26, 28, 30, 31, 32, 33, 35, 36, 37, 38, 39, 40, 42, 44, 46, 405, 407, 409, 411, 413, 415, 417, 158, 162, 395, 473, 477; CDRH SEQ ID NO: 47, 48, 49, 50, 51, 52, 53, 54, 55, 56, 57, 58, 60, 62, 64, 65, 67, 69, 71, 72, 74, 76, 77, 78, 79, 80, 81, 83, 85, 87, 89, 91, 404, 406, 408, 410, 412, 414, 416, 180, 175, 308, 368, 471, 475; | US20120213797A1 |
| CDRL SEQ ID NO: 5, 7, 9, 10, 12, 13, 15, 16, 17, 18, 19, 20, 21, 22, 23, 24, 26, 28, 30, 31, 32, 33, 35, 36, 37, 38, 39, 40, 42, 44, 46, 405, 407, 409, 411, 413, 415, 417; CDRH SEQ ID NO: 47, 48, 49, 50, 51, 52, 53, 54, 55, 56, 57, 58, 60, 62, 64, 65, 67, 69, 71, 72, 74, 76, 77, 78, 79, 80, 81, 83, 85, 87, 89, 91, 404, 406, 408, 410, 412, 414, 416; | US20120251544A1 |
| CDRL SEQ ID NO: 5, 7, 9, 10, 12, 13, 15, 16, 17, 18, 19, 20, 21, 22, 23, 24, 26, 28, 30, 31, 32, 33, 35, 36, 37, 38, 39, 40, 42, 44, 46, 405, 407, 409, 411, 413, 415, 417, 461, 465, 485; CDRH SEQ ID NO: 47, 48, 49, 50, 51, 52, 53, 54, 55, 56, 57, 58, 60, 62, 64, 65, 67, 69, 71, 72, | US20130052201A1 |
| 74, 76, 77, 78, 79, 80, 81, 83, 85, 87, 89, 91, 404, 406, 408, 410, 412, 414, 416, 459, 463, 483; CDRL SEQ ID NO: 5, 7, 9, 10, 12, 13, 15, 16, 17, 18, 19, 20, 21, 22, 23, 24, 26, 28, 30, 31, 32, 33, 35, 36, 37, 38, 39, 40, 42, 44, 46, 405, 407, 409, 411, 413, 415, 417, 461, 465, 485; CDRH SEQ ID NO: 47, 48, 49, 50, 51, 52, 53, 54, 55, 56, 57, 58, 60, 62, 64, 65, 67, 69, 71, 72, 74, 76, 77, 78, 79, 80, 81, 83, 85, 87, 89, 91, 404, 406, 408, 410, 412, 414, 416, 459, 463, 483; | US20130058944A1 |
| CDRL SEQ ID NO: 5, 7, 9, 10, 12, 13, 15, 16, 17, 18, 19, 20, 21, 22, 23, 24, 26, 28, 30, 31, 32, 33, 35, 36, 37, 38, 39, 40, 42, 44, 46, 405, 407, 409, 411, 413, 415, 417; CDRH SEQ ID NO: 47, 48, 49, 50, 51, 52, 53, 54, 55, 56, 57, 58, 60, 62, 64, 65, 67, 69, 71, 72, 74, 76, 77, 78, 79, 80, 81, 83, 85, 87, 89, 91, 404, 406, 408, 410, 412, 414, 416; | US20130079502A1 |
| CDRL SEQ ID NO: 5, 7, 9, 10, 12, 13, 15, 16, 17, 18, 19, 20, 21, 22, 23, 24, 26, 28, 30, 31, 32, 33, 35, 36, 37, 38, 39, 40, 42, 44, 46, 405, 407, 409, 411, 413, 415, 417; CDRH SEQ ID NO: 47, 48, 49, 50, 51, 52, 53, 54, 55, 56, 57, 58, 60, 62, 64, 65, 67, 69, 71, 72, 74, 76, 77, 78, 79, 80, 81, 83, 85, 87, 89, 91, 404, 406, 408, 410, 412, 414, 416; | US20130245235A1 |

TABLE 9

Human variable & constant variants distributed over several human ethnic populations - useful for ligand tailoring

| Human Gene Segment Type | Example Human Allele[1] | Amino Acid Position & Variation | Nucleotide Variation[2] (NCBI dbSNP reference number)[3] | Variant Nucleotide Position | Human Populations[4] | No Individs[5] | Het Freq[6] | Hom Freq[7] (Het + Hom freq[8]) | Cum Freq[9] |
|---|---|---|---|---|---|---|---|---|---|
| IGHG1 | IGHG1*01 | 204D (CH3 variation) | GA<u>T</u> | 14:106208086 (forward strand) | A (European ancestry) | 153 | 0.400 | 0.096 (0.496) | 0.296 |
|  | IGHG1*03 | 204E (CH3 variation) | GA<u>G</u> (rs1045853) | 14:106208086 (forward strand) | A (European ancestry) | 366 | 0.400 | 0.504 (0.904) | 0.704 |
|  | IGHG1*01 | 206L (CH3 variation) | <u>C</u>TG | 14:106208082 (forward strand) | A (European ancestry) |  | 0.358 | 0.104 (0.462) | 0.283 |
|  | IGHG1*03 | 206M (CH3 variation) | <u>A</u>TG (rs11621259) | 14:106208082 (forward strand) | A (European ancestry) |  | 0.358 | 0.538 (0.896) | 0.717 |
| IGHG2 | IGHG2*01 | 72P (CH1 variation) | CC<u>C</u> | 14:106110914 (forward strand) | B |  | 0.336 | 0.540 (0.876) | 0.708 |
|  | IGHG2*02 | 72T (CH1 variation) | A<u>C</u>C (rs11627594) | 14:106110914 (forward strand) | B |  | 0.336 | 0.124 (0.292) | 0.292 |
|  | IGHG2*01 | 75N (CH1 variation) | A<u>A</u>C | 14:106110904 (forward strand) | A |  | 0.007 | 0.993 | 0.997 |
|  | IGHG2*04 | 75S (CH1 variation) | A<u>G</u>C (rs201590297) | 14:106110904 (forward strand) | A |  | 0.007 |  | 0.004 |
|  | IGHG2*01 | 76F (CH1 variation) | TT<u>C</u> |  |  |  |  |  |  |
|  | IGHG2*04 | 76L (CH1 variation) | TT<u>G</u> |  |  |  |  |  |  |
|  | IGHG2*01 | 161V (CH2 variation) | <u>G</u>TG | 14:10611013 (forward strand) | B |  | 0.342 | 0.539 (0.881) | 0.711 |
|  | IGHG2*02 | 161M (CH2 variation) | <u>A</u>TG (rs8009156) | 14:10611013 (forward strand) | B |  | 0.342 | 0.118 (0.46) | 0.289 |

TABLE 9-continued

Human variable & constant variants distributed over several human ethnic populations - useful for ligand tailoring

| Human Gene Segment Type | Example Human Allele[1] | Amino Acid Position & Variation | Nucleotide Variation[2] (NCBI dbSNP reference number)[3] | Variant Nucleotide Position | Human Populations[4] | No Individs[5] | Het Freq[6] | Hom Freq[7] (Het + Hom freq[8]) | Cum Freq[9] |
|---|---|---|---|---|---|---|---|---|---|
| | IGHG2*01 | 257A (CH3 variation) | GCC | 14:106109752 (forward strand) | C | | 0.199 | 0.493 (0.692) | 0.592 |
| | | | | | D | | 0.007 | 0.992 (0.999) | 0.995 |
| | IGHG2*06 | 257S (CH3 variation) | TCC (rs4983499) | 14:106109752 (forward strand) | C | | 0.199 | 0.308 (0.507) | 0.408 |
| | | | | | D | | 0.007 | 0.002 (0.009) | 0.005 |
| IGHG4 | IGHG4*01 | 189L (CH2 variation) | CTG | 14:105624992 (forward strand) | B | 1047 | 0.315 | 0.644 (0.959) | 0.801 |
| | IGHG4*02 | 189V (CH2 variation) | GTG (rs8015545) | 14:105624992 (forward strand) | B | 389 | 0.315 | 0.041 (0.356) | 0.199 |
| | IGHG4*01 | 289R (CH3 variation) | AGG | 14:105624594 (forward strand) | | | | | |
| | IGHG4*03 | 289K (CH3 variation) | AAG (rs77498506) | 14:105624594 (forward strand) | | | | | |

Table Footnotes:
[1]IMGT notation (ww.imgt.org); refer to figures for other alleles comprising this variation.
[2]SNP Underlined in Codon.
[3]NCBI dbSNP Build 138 released on Apr. 25, 2013.
[4]Human population used for representative variant frequency analysis.
Populations
A This population included 662 participants of European descent from the ClinSeq project, all of whom had undergone whole-exome sequencing using Agilent's 38 Mb or 50 Mb capture kit.
B 1000 Genomes database.
C ESP6500: African_American.
D ESP6500: European_American.
[5]Number of individuals in representative population found to have the allele.
[6]Heterozygous human genotype frequency, ie, cumulative frequency of all genotypes having one occurrence of the variant allele and one occurrence of another allele (heterozygous state), eg, ac genotype in the population.
[7]Homozygous human genotype frequency, ie, cumulative frequency of two occurrences of the variant allele (homozygous state), eg, cc genotype in the population.
[8]Total human genotype frequency, ie, total of heterozygous plus homozygous human genotype frequencies.
[9]Cumulative human allele frequency of all occurrences of the variant allele in the population.

TABLE 10

FURTHER SEQUENCES

| SEQ ID NO: | Human Allele | Nucleotide/Amino Acid Sequence |
|---|---|---|
| | | HEAVY CHAIN ALLELES |
| 41 | IGHG1*01 (CH1 + Hinge + CH2 + CH3 + CH – S) | gcctccaccaagggcccatcggtcttccccctggcaccctcctccaaga gcacctctggg<br>ggcacagcggccctgggctgcctggtcaaggactacttccccgaaccgg tgacggtgtcg<br>tggaactcaggcgccctgaccagcggcgtgcacaccttcccggctgtcc tacagtcctca<br>ggactctactccctcagcagcgtggtgaccgtgccctccagcagcttgg gcacccagacc<br>tacatctgcaacgtgaatcacaagcccagcaacaccaaggtggacaaga agttgagccc<br>aaatcttgtgacaaaactcacacatgcccaccgtgcccagcacctgaac tcctgggggga<br>ccgtcagtcttcctcttccccccaaaacccaaggacaccctcatgatct cccggacccct<br>gaggtcacatgcgtggtggtggacgtgagccacgaagaccctgaggtca agttcaactgg<br>tacgtggacggcgtggaggtgcataatgccaagacaaagccgcgggagg agcagtacaac<br>agcacgtaccgggtggtcagcgtcctcaccgtcctgcaccaggactggc tgaatggcaag<br>gagtacaagtgcaaggtctccaacaaagcccctcccagcccccatcgaga aaaccatctcc |

TABLE 10-continued

| | | FURTHER SEQUENCES |
|---|---|---|
| SEQ ID NO: | Human Allele | Nucleotide/Amino Acid Sequence |
| | | aaagccaaagggcagccccgagaaccacaggtgtacaccctgcccccat cccgggatgag ctgaccaagaaccaggtcagcctgacctgcctggtcaaaggcttctatc ccagcgacatc gccgtggagtgggagagcaatgggcagccggagaacaactacaagacca cgcctcccgtg ctggactccgacggctccttcttcctctacagcaagctcaccgtggaca gagcaggtgg cagcaggggaacgtcttctcatgctccgtgatgcatgaggctctgcaca accactacacg cagaagagcctctccctgtctccgggtaaa |
| 42 | | ASTKGPSVFPLAPSSKSTSGGTAALGCLVKDYFPEPVTVSWNSGALTSG VHTFPAVLQSS GLYSLSSVVTVPSSSLGTQTYICNVNHKPSNTKVDKKVEPKSCDKTHTC PPCPAPELLGG PSVFLFPPKPKDTLMISRTPEVTCVVVDVSHEDPEVKFNWYVDGVEVHN AKTKPREEQYN STYRVVSVLTVLHQDWLNGKEYKCKVSNKALPAPIEKTISKAKGQPREP QVYTLPPSRDE LTKNQVSLTCLVKGFYPSDIAVEWESNGQPENNYKTTPPVLDSDGSFFL YSKLTVDKSRW QQGNVFSCSVMHEALHNHYTQKSLSLSPGK D = position 204 L = position 206 |
| 43 | IGHG2*01 (CH1 + Hinge + CH2 + CH3 + CH-S) | gcctccaccaagggcccatcggtcttccccctggcgccctgctccagga gcacctccgag agcacagccgccctgggctgcctggtcaaggactacttccccgaaccgg tgacggtgtcg tggaactcaggcgctctgaccagcggcgtgcacaccttcccagctgtcc tacagtcctca ggactctactccctcagcagcgtggtgaccgtgccctccagcaacttcg gcacccagacc tacacctgcaacgtagatcacaagcccagcaacaccaaggtggacaaga cagttgagcgc aaatgttgtgtcgagtgcccaccgtgcccagcaccacctgtggcaggac cgtcagtcttc ctcttccccccaaaacccaaggacaccctcatgatctcccggacccctg aggtcacgtgc gtggtggtggacgtgagccacgaagaccccgaggtccagttcaactggt acgtggacggc gtggaggtgcataatgccaagacaaagccacgggaggagcagttcaaca gcacgttccgt gtggtcagcgtcctcaccgttgtgcaccaggactggctgaacggcaagg agtacaagtgc aaggtctccaacaaaggcctcccagcccccatcgagaaaaccatctcca aaaccaaaggg cagccccgagaaccacaggtgtacaccctgcccccatcccgggaggaga tgaccaagaac caggtcagcctgacctgcctggtcaaaggcttctaccccagcgacatcg ccgtggagtgg gagagcaatgggcagccggagaacaactacaagaccacacctcccatgc tggactccgac ggctccttcttcctctacagcaagctcaccgtggacaagagcaggtggc agcaggggaac gtcttctcatgctccgtgatgcatgaggctctgcacaaccactacacgc agaagagcctc tccctgtctccgggtaaa |
| 44 | | ASTKGPSVFPLAPCSRSTSESTAALGCLVKDYFPEPVTVSWNSGALTSG VHTFPAVLQSS GLYSLSSVVTVPSSNFGTQTYTCNVDHKPSNTKVDKTVERKCCVECPPC PAPPVAGPSVF LFPPKPKDTLMISRTPEVTCVVVDVSHEDPEVQFNWYVDGVEVHNAKTK PREEQFNSTFR VVSVLTVVHQDWLNGKEYKCKVSNKGLPAPIEKTISKTKGQPREPQVYT LPPSREEMTKN QVSLTCLVKGFYPSDIAVEWESNGQPENNYKTTPPMLDSDGSFFLYSKL TVDKSRWQQGN VFSCSVMHEALHNHYTQKSLSLSPGK P = position 72 N = position 75 F = position 76 V = position 161 A = position 257 |

TABLE 10-continued

| | | FURTHER SEQUENCES |
|---|---|---|
| SEQ ID NO: | Human Allele | Nucleotide/Amino Acid Sequence |
| 45 | IGHV1-18*01 | caggttcagctggtgcagtctggagctgaggtgaagaagcctggggcct cagtgaaggtc tcctgcaaggcttctggttacacctttaccagctatggtatcagctggg tgcgacaggcc cctggacaagggcttgagtggatgggatggatcagcgcttacaatggta acacaaactat gcacagaagctccagggcagagtcaccatgaccacagacacatccacga gcacagcctac atggagctgaggagcctgagatctgacgacacggccgtgtattactgtg cgagaga |
| 46 | | QVQLVQSGAEVKKPGASVKVSCKASGYTFTSYGISWVRQAP GQGLEWMGWISAYNGNTNYAQKLQGRVTMTTDTSTSTAYMELRSLRSDD TAVYYCAR |
| 47 | IGHV1-46*01 | caggtgcagctggtgcagtctggggctgaggtgaagaagcctggggcct cagtgaaggtt tcctgcaaggcatctggatacaccttcaccagctactatatgcactggg tgcgacaggcc cctggacaagggcttgagtggatgggaataatcaaccctagtggtggta gcacaagctac gcacagaagttccagggcagagtcaccatgaccagggacacgtccacga gcacagtctac atggagctgagcagcctgagatctgaggacacggccgtgtattactgtg cgagaga |
| 48 | | QVQLVQSGAEVKKPGASVKVSCKASGYTFTSYYMHWVRQAP GQGLEWMGIINPSGGSTSYAQKFQGRVTMTRDTSTSTVYMELSSLRSED TAVYYCAR |

| | | LIGHT CHAIN ALLELES |
|---|---|---|
| 49 | IGKC*01 | cgaactgtggctgcaccatctgtcttcatcttcccgccatctgatgagc agttgaaatct ggaactgcctctgttgtgtgcctgctgaataacttctatcccagagagg ccaaagtacag tggaaggtggataacgcccctccaatcgggtaactcccaggagagtgtca cagagcaggac agcaaggacagcacctacagcctcagcagcaccctgacgctgagcaaag cagactacgag aaacacaaagtctacgcctgcgaagtcacccatcagggcctgagctcgc ccgtcacaaag agcttcaacaggggagagtgt |
| 50 | | RTVAAPSVFIFPPSDEQLKSGTASVVCLLNNFYPREAKVQWKVDNALQS GNSQESVTEQD SKDSTYSLSSTLTLSKADYEKHKVYACEVTHQGLSSPVTKSFNRGEC V = position 84 C = position 87 |
| 51 | IGLC2*01 | ggtcagcccaaggctgccccctcggtcactctgttcccgccctcctctg aggagcttcaa gccaacaaggccacactggtgtgtctcataagtgacttctacccgggag ccgtgacagtg gcttggaaagcagatagcagccccgtcaaggcgggagtggagaccacca cccctccaaa caaagcaacaacaagtacgcggccagcagctatctgagcctgacgcctg agcagtggaag tcccacagaagctacagctgccaggtcacgcatgaagggagcaccgtgg agaagacagtg gccccctacagaatgttca |
| 52 | | GQPKAAPSVTLFPPSSEELQANKATLVCLISDFYPGAVTVAWKADSSPV KAGVETTTPSK QSNNKYAASSYLSLTPEQWKSHRSYSCQVTHEGSTVEKTVAPTECS |
| 53 | IGKV4-1*01 | atggtgttgcagacccaggtcttcatttctctgttgctctggatctctg gtgcctacggg gacatcgtgatgacccagtctccagactccctggctgtgtctctgggcg agagggccacc atcaactgcaagtccagccagagtgttttatacagctccaacaataaga actacttagct tggtaccagcagaaaccaggacagcctcctaagctgctcatttactggg catctacccgg gaatccggggtccctgaccgattcagtggcagcgggtctgggacagatt tcactctcacc atcagcagcctgcaggctgaagatgtggcagtttattactgtcagcaat |

TABLE 10-continued

FURTHER SEQUENCES

| SEQ ID NO: | Human Allele | Nucleotide/Amino Acid Sequence |
|---|---|---|
| 54 | | attatagtact<br>cctcc<br>DIVMTQSPDSLAVSLGERATINCKSSQSVLYSSNNKNYLA<br>WYQQKPGQPPKLLIYWASTRESGVPDRFSGSGSGTDFTLTISSLQAEDV<br>AVYYCQQYYST<br>P |
| 55 | IGKV1-13*02 | atggacatgagggtccccgctcagctcctggggcttctgctgctctggc<br>tcccagcaggt<br>gccagatgtgccatccagttgacccagtctccatcctccctgtctgcat<br>ctgtaggagac<br>agagtcaccatcacttgccgggcaagtcagggcattagcagtgctttag<br>cctggtatcag<br>cagaaaccagggaaagctcctaagctcctgatctatgatgcctccagtt<br>tggaaagtggg<br>gtcccatcaaggttcagcggcagtggatctgggacagatttcactctca<br>ccatcagcagc<br>ctgcagcctgaagattttgcaacttattactgtcaacagtttaatagtt<br>accctcagtgc<br>cagatgtgccatccagttgacccagtctccatcctccctgtctgcatct<br>gtaggagacag<br>agtcaccatcacttgccgggcaagtcagggcattagcagtgctttagcc<br>tggtatcagca<br>gaaaccagggaaagctcctaagctcctgatctatgatgcctccagtttg<br>gaaagtgggt<br>cccatcaaggttcagcggcagtggatctgggacagatttcactctcacc<br>atcagcagcct<br>gcagcctgaagattttgcaacttattactgtcaacagtttaatagttac<br>cctca |
| 57 | IGKJ2*01 | tgtacacttttggccaggggaccaagctggagatcaaac |
| 58 | | YTFGQGTKLEIK |
| 59 | IGLJ2*01 | tgtggtattcggcggagggaccaagctgaccgtcctag |
| 60 | | VVFGGGTKLTVL |
| 61 | An IGHG1*01 Heavy Chain Constant Region | ASTKGPSVFPLAPSSKSTSGGTAALGCLVKDYFPEPVTVSWNSGALTSG<br>VHTFPAVLQSSGLYSLSSVVTVPSSSLGTQTYICNVNHKPSNTKVDKKV<br>EPKSCDKTHTCPPCPAPELLGGPS<br>VFLFPPKPKDTLMISRTPEVTCVVVDVSHEDPEVKFNWYVDGVEVHNAK<br>TKPREEQYNST<br>YRVVSVLTVLHQDWLNGKEYKCKVSNKALPAPIEKTISKAKGQPREPQV<br>YTLPPSRDELT<br>KNQVSLTCLVKGFYPSDIAVEWESNGQPENNYKTTPPVLDSDGSFFLYS<br>KLTVDKSRWQQGNVFSCSVMHEALHNHYTQKSLSLSPG |
| 62 | An IGKC*01 Kappa Light Chain Constant Region | RTVAAPSVFIFPPSDEQLKSGTASVVCLLNNFYPREAKVQWKVDNALQS<br>GNSQESVTEQDSKDSTYSLSSTLTLSKADYEKHKVYACEVTHQGLSSPV<br>TKSFNRGEC |
| 63 | An IGHG2*01 Heavy Chain Constant Region | ASTKGPSVFPLAPCSRSTSESTAALGCLVKDYFPEPVTVSWNSGALTSG<br>VHTFPAVLQSSGLYSLSSVVTVPSSNFGTQTYTCNVDHKPSNTKVDKTV<br>ERKCCVECPPCPAPPVAGPSVFLFPPKPKDTLMISRTPEVTCVVVDVSH<br>EDPEVQFNWYVDGVEVHNAKTKPREEQFNSTFRVVSVLTVVHQDWLNGK<br>EYKCKVSNKGLPAPIEKTISKTKGQPREPQVYTLPPSREEMTKNQVSLT<br>CLVKGFYPSDIAVEWESNGQPENNYKTTPPMLDSDGSFFLYSKLTVDKS<br>RWQQGNVFSCSVMHEALHNHYTQKSLSLSPGK |
| 64 | An IGLC2*01 Lambda Light Chain Constant Region | QPKAAPSVTLFPPSSEELQANKATLVCLISDFYPGAVTVAWKADSSPVK<br>AGVETTTPSKQSNNKYAASSYLSLTPEQWKSHRSYSCQVTHEGSTVEKT<br>VAPTECS |
| 65 | An IGHG2*01 Heavy Chain Constant Region | ASTKGPSVFPLAPCSRSTSESTAALGCLVKDYFPEPVTVSWNSGALTSG<br>VHTFPAVLQSSGLYSLSSVVTVPSSNFGTQTYTCNVDHKPSNTKVDKTV<br>ERKCCVECPPCPAPPVAGPSVFLFPPKPKDTLMISRTPEVTCVVVDVSH<br>EDPEVQFNWYVDGVEVHNAKTKPREEQFNSTFRVVSVLTVVHQDWLNGK<br>EYKCKVSNKGLPSSIEKTISKTKGQPREPQVYTLPPSREEMTKNQVSLT<br>CLVKGFYPSDIAVEWESNGQPENNYKTTPPMLDSDGSFFLYSKLTVDKS<br>RWQQGNVFSCSVMHEALHNHYTQKSLSLSPGK |

TABLE 10-continued

FURTHER SEQUENCES

| SEQ ID NO: | Human Allele | Nucleotide/Amino Acid Sequence |
|---|---|---|
| 66 | An IGKC*01 Kappa Light Chain Constant Region | RTVAAPSVFIFPPSDEQLKSGTASVVCLLNNFYPREAKVQWKVDNALQS GNSQESVTEQDSKDSTYSLSSTLTLSKADYEKHKVYACEVTHQGLSSPV TKSFNRGEC |

HUMAN IL4Ra SEQUENCES

| 67 | Amino Acid Sequence | MGWLCSGLLFPVSCLVLLQVASSGNMKVLQEPTCVSDYMSISTCEWKMNGPTNC STELRLLYQLVFLLSEAHTCIPENNGGAGCVCHLLMDDVVSADNYTLDLWAGQQ LLWKGSFKPSEHVKPRAPGNLTVHTNVSDTLLLTWSNPYPPDNYLYNHLTYAVN IWSENDPADFRIYNVTYLEPSLRIAASTLKSGISYRARVRAWAQCYNTTWSEWS PSTKWHNSYREPFEQHLLLGVSVSCIVILAVCLLCYVSITKIKKEWWDQIPNPA RSRLVAIIQDAQGSQWEKRSRGQEPAKCPHWKNCLTKLLPCFLEHNMKRDEDP HKAAKEMPFQGSGKSAWCPVEISKTVLWPESISVVRCVELFEAPVECEEEEEVE EEKGSFCASPESSRDDFQEGREGIVARLTESLFLDLLGEENGGFCQQDMGESCL LPPSGSTSAHMPWDEFPSAGPKEAPPWGKEQPLHLEPSPPASPTQSPDNLTCTE TPLVIAGNPAYRSFSNSLSQSPCPRELGPDPLLARHLEEVEPEMPCVPQLSEPT TVPQPEPETWEQILRRNVLQHGAAAAPVSAPTSGYQEFVHAVEQGGTQASAVVG LGPPGEAGYKAFSSLLASSAVSPEKCGFGASSGEEGYKPFQDLIPGCPGDPAPV PVPLFTFGLDREPPRSPQSSHLPSSSPEHLGLEPGEKVEDMPKPPLPQEQATDP LVDSLGSGIVYSALTCHLCGHLKQCHGQEDGGQTPVMASPCCGCCCGDRSSPPT TPLRAPDPSPGGVPLEASLCPASLAPSGISEKSKSSSSFHPAPGNAQSSSQTPK IVNFVSVGPTYMRVS<br>I = position 75<br>E = position 400<br>C = position 431<br>S = position 503<br>Q = position 576<br>S = position 752 |
| 68 | Nucleotide Sequence | ATGGGGTGGCTTTGCTCTGGGCTCCTGTTCCCTGTGAGCTGCCTGGTCCTGCTG CAGGTGGCAAGCTCTGGGAACATGAAGGTCTTGCAGGAGCCCACCTGCGTCTCC GACTACATGAGCATCTCTACTTGCGAGTGGAAGATGAATGGTCCCACCAATTGC AGCACCGAGCTCCGCCTGTTGTACCAGCTGGTTTTTCTGCTCTCCGAAGCCCAC ACGTGTATCCCTGAGAACAACGGAGGCGCGGGGTGCGTGTGCCACCTGCTCATG GATGACGTGGTCAGTGCGGATAACTATACACTGGACCTGTGGGCTGGGCAGCAG CTGCTGTGGAAGGGCTCCTTCAAGCCCAGCGAGCATGTGAAACCCAGGGCCCCA GGAAACCTGACAGTTCACACCAATGTCTCCGACACTCTGCTGCTGACCTGGAGC AACCCGTATCCCCCTGACAATTACCTGTATAATCATCTCACCTATGCAGTCAAC ATTTGGAGTGAAAACGACCCGGCAGATTTCAGAATCTATAACGTGACCTACCTA GAACCCTCCCTCCGCATCGCAGCCAGCACCCTGAAGTCTGGGATTTCCTACAGG GCACGGGTGAGGGCCTGGGCTCAGTGCTATAACACCACCTGGAGTGAGTGGAGC CCCAGCACCAAGTGGCACAACTCCTACAGGGAGCCCTTCGAGCAGCACCTCCTG CTGGGCGTCAGCGTTTCCTGCATTGTCATCCTGGCCGTCTGCCTGTTGTGCTAT GTCAGCATCACCAAGATTAAGAAAGAATGGTGGGATCAGATTCCCAACCCAGCC CGCAGCCGCCTCGTGGCTATAATAATCCAGGATGCTCAGGGGTCACAGTGGGAG AAGCGGTCCCGAGGCCAGGAACCAGCCAAGTGCCCACACTGGAAGAATTGTCTT ACCAAGCTCTTGCCCTGTTTTCTGGAGCACAACATGAAAAGGGATGAAGATCCT CACAAGGCTGCCAAAGAGATGCCTTTCCAGGGCTCTGGAAAATCAGCATGGTGC CCAGTGGAGATCAGCAAGACAGTCCTCTGGCCAGAGAGCATCAGCGTGGTGCGA TGTGTGGAGTTGTTTGAGGCCCCGGTGGAGTGTGAGGAGGAGGAGGAGGTAGAG GAAGAAAAAGGGAGCTTCTGTGCATCGCCTGAGAGCAGCAGGGATGACTTCCAG GAGGGAAGGGAGGGCATTGTGGCCCGGCTAACAGAGAGCCTGTTCCTGGACCTG CTCGGAGAGGAGAATGGGGGCTTTTGCCAGCAGGACATGGGGGAGTCATGCCTT CTTCCACCTTCGGGAAGTACGAGTGCTCACATGCCCTGGGATGAGTTCCCAAGT GCAGGGCCCAAGGAGGCACCTCCCTGGGGCAAGGAGCAGCCTCTCCACCTGGAG CCAAGTCCTCCTGCCAGCCCGACCCAGAGTCCAGACAACCTGACTTGCACAGAG ACGCCCCTCGTCATCGCAGGCAACCCTGCTTACCGCAGCTTCAGCAACTCCCTG AGCCAGTCACCGTGTCCCAGAGAGCTGGGTCCAGACCCACTGCTGGCCAGACAC CTGGAGGAAGTAGAACCCGAGATGCCCTGTGTCCCCCAGCTCTCTGAGCCAACC ACTGTGCCCCAACCTGAGCCAGAAACCTGGGAGCAGATCCTCCGCCGAAATGTC CTCCAGCATGGGGCAGCTGCAGCCCCGTCTCGGCCCCACCAGTGGCTATCAG GAGTTTGTACATGCGGTGGAGCAGGGTGGCACCCAGGCCAGTGCGGTGGTGGGC TTGGGTCCCCAGGAGAGGCTGGTTACAAGGCCTTCTCAAGCCTGCTTGCCAGC AGTGCTGTGTCCCAGAGAAATGTGGGTTTGGGGCTAGCAGTGGGGAAGAGGGG TATAAGCCTTTCCAAGACCTCATTCCTGGCTGCCCTGGGGACCCTGCCCCAGTC CCTGTCCCCTTGTTCACCTTTGGACTGGACAGGGAGCCACCTCGCAGTCCGCAG AGCTCACATCTCCCAAGCAGCTCCCAGAGCACCTGGGTCTGGAGCCGGGGGAA AAGGTAGAGGACATGCCAAAGCCCCCACTTCCCCAGGAGCAGGCCACAGACCCC CTTGTGGACAGCCTGGGCAGTGGCATTGTCTACTCAGCCCTTACCTGCCACCTG TGCGGCCACCTGAAACAGTGTCATGGCCAGGAGGATGGTGGCCAGACCCCTGTC ATGGCCAGTCCTTGCTGTGGCTGCTGCTGTGGAGACAGGTCCTCGCCCCCTACA ACCCCCCTGAGGGCCCCAGACCCCTCTCCAGGTGGGGTTCCACTGGAGGCCAGT |

TABLE 10-continued

FURTHER SEQUENCES

| SEQ ID NO: | Human Allele | Nucleotide/Amino Acid Sequence |
|---|---|---|
| | | CTGTGTCCGGCCTCCCTGGCACCCTCGGGCATCTCAGAGAAGAGTAAATCCTCA
TCATCCTTCCATCCTGCCCCTGGCAATGCTCAGAGCTCAAGCCAGACCCCCAAA
ATCGTGAACTTTGTCTCCGTGGGACCCACATACATGAGGGTCTCTTAG |

ANTI-HUMAN IL4Ra ANTIBODY SEQUENCES

| 69 | VH | EVQLVESGGG LEQPGGSLRLSCAGSGFTFR DYAMTWVRQA PGKGLEWVSS
ISGSGGNTYY ADSVKGRFTISRDNSKNTLY LQMNSLRAEDTAVYYCAKDR
LSITIRPRYYGLDVWGQGTTVTVSS |
| 70 | VL | DIVMTQSPLSLPVTPGEPASISCRSSQSLLYSIGYNYLDWYLQKSGQSPQ
LLIYLGSNRASGVPDRFSGSGSGTDFTLKISRVEAEDVGFYYCMQALQTP
YTFGQGTKLEIK |
| 71 | HEAVY CHAIN | EVQLVESGGG LEQPGGSLRL SCAGSGFTFR DYAMTWVRQA PGKGLEWVSS
ISGSGGNTYY ADSVKGRFTI SRDNSKNTLY LQMNSLRAED TAVYYCAKDR
LSITIRPRYY GLDVWGQGTT VTVSSASTKG PSVFPLAPCS RSTSESTAAL
GCLVKDYFPE PVTVSWNSGA LTSGVHTFPA VLQSSGLYSL SSVVTVPSSS
LGTKTYTCNV DHKPSNTKVD KRVESKYGPP CPPCPAPEFL GGPSVFLFPP
KPKDTLMISR TPEVTCVVVD VSQEDPEVQF NWYVDGVEVH NAKTKPREEQ
FNSTYRVVSV LTVLHQDWLN GKEYKCKVSN KGLPSSIEKT ISKAKGQPRE
PQVYTLPPSQ EEMTKNQVSL TCLVKGFYPS DIAVEWESNG QPENNYKTTP
PVLDSDGSFF LYSRLTVDKS RWQEGNVFSC SVMHEALHNH YTQKSLSLSL
G |
| 72 | LIGHT CHAIN | DIVMTQSPLSLPVTPGEPASISCRSSQSLLYSIGYNYLDWYLQKSGQSPQ
LLIYLGSNRASGVPDRFSGSGSGTDFTLKISRVEAEDVGFYYCMQALQTP
YTFGQGTKLEIKRTVAAPSV FIFPPSDEQLKSGTASVVCLLNNFYPREAK
VQWKVDNALQSGNSQESVTEQDSKDSTYSLSSTLTLSKADYEKHKVYACE
VTHQGLSSPVTKSF |

HUMAN IGHG4 SEQUENCES

| 73 | IGHG4*01 AMINO ACID SEQUENCE | ASTKGPSVFPLAPCSRSTSESTAALGCLVKDYFPEPVTVSWNSGALTSG
VHTFPAVLQSSGLYSLSSVVTVPSSSLGTKTYTCNVDHKPSNTKVDKRV
ESKYGPPCPSCPAPEFLGGPSVFLFPPKPKDTLMISRTPEVTCVVVDVS
QEDPEVQFNWYVDGVEVHNAKTKPREEQFNSTYRVVSVLTVLHQDWLNG
KEYKCKVSNKGLPSSIEKTISKAKGQPREPQVYTLPPSQEEMTKNQVSL
TCLVKGFYPSDIAVEWESNGQPENNYKTTPPVLDSDGSFFLYSRLTVDK
SRWQEGNVFSCSVMHEALHNHYTQKSLSLSLGK
L = position 189
R = position 289 |
| 74 | IGHG4*01 NUCLEOTIDE SEQUENCE | GCTTCCACCAAGGGCCCATCGGTCTTCCCCCTGGCGCCCTGCTCCAGGA
GCACCTCCGAGAGCACAGCCGCCCTGGGCTGCCTGGTCAAGGACTACTT
CCCCGAACCGGTGACGGTGTCGTGGAACTCAGGCGCCCTGACCAGCGGC
GTGCACACCTTCCCGGCTGTCCTACAGTCCTCAGGACTCTACTCCCTCA
GCAGCGTGGTGACCGTGCCCTCCAGCAGCTTGGGCACGAAGACCTACAC
CTGCAACGTAGATCACAAGCCCAGCAACACCAAGGTGGACAAGAGAGTT
GAGTCCAAATATGGTCCCCCATGCCCATCATGCCCAGCACCTGAGTTCC
TGGGGGGACCATCAGTCTTCCTGTTCCCCCCAAAACCCAAGGACACTCT
CATGATCTCCCGGACCCCTGAGGTCACGTGCGTGGTGGTGGACGTGAGC
CAGGAAGACCCCGAGGTCCAGTTCAACTGGTACGTGGATGGCGTGGAGG
TGCATAATGCCAAGACAAAGCCGCGGGAGGAGCAGTTCAACAGCACGTA
CCGTGTGGTCAGCGTCCTCACCGTCCTGCACCAGGACTGGCTGAACGGC
AAGGAGTACAAGTGCAAGGTCTCCAACAAAGGCCTCCCGTCCTCCATCG
AGAAAACCATCTCCAAAGCCAAAGGGCAGCCCCGAGAGCCACAGGTGTA
CACCCTGCCCCCATCCCAGGAGGAGATGACCAAGAACCAGGTCAGCCTG
ACCTGCCTGGTCAAAGGCTTCTACCCCAGCGACATCGCCGTGGAGTGGG
AGAGCAATGGGCAGCCGGAGAACAACTACAAGACCACGCCTCCCGTGCT
GGACTCCGACGGCTCCTTCTTCCTCTACAGCAGGCTCACCGTGGACAAG
AGCAGGTGGCAGGAGGGGAATGTCTTCTCATGCTCCGTGATGCATGAGG
CTCTGCACAACCACTACACACAGAAGAGCCTCTCCCTGTCTCTGGGTAA
ATGA
C = position 565 (CTG encodes 189V)
G = position 866 (AGG encodes 289R) |

Nav1.7 SEQUENCES

| 75 | HUMAN Nav1.7 AMINO ACID SEQUENCE (ENST00000303354) | MAMLPPPGPQSFVHFTKQSLALIEQRIAERKSKEPKEEKKDDDEEAPKPSSDLEAG
KQLPFIYGDIPPGMVSEPLEDLDPYYADKKTFIVLNKGKTIFRFNATPALYMLSPFS
PLRRISIKILVHSLFSMLIMCTILTNCIFMTMNNPPDWTKNVEYTFTGIYTFESLVKI
LARGFCVGEFTFLRDPWNWLDFVVIVFAYLTEFVNLGNVSALRTFRVLRALKTISVI
PGLKTIVGALIQSVKKLSDVMILTVFCLSVFALIGLQLFMGNLKHKCFRNSLENNET |

TABLE 10-continued

FURTHER SEQUENCES

| SEQ ID NO: | Human Allele | Nucleotide/Amino Acid Sequence |
|---|---|---|
| | | LESIMNTLESEEDFRKYFYYLEGSKDALLCGFSTDSGQCPEGYTCVKIGRNPDYGYT<br>SFDTFSWAFLALFRLMTQDYWENLYQQTLRAAGKTYMIFFVVVIFLGSFYLINLIL<br>AVVAMAYEEQNQANIEEAKQKELEFQQMLDRLKKEQEEAEAIAAAAAEYTSIRRS<br>RIMGLSESSSETSKLSSKSAKERRNRRKKKNQKKLSSGEEKGDAEKLSKSESEDSIRR<br>KSFHLGVEGHRRAHEKRLSTPNQSPLSIRGSLFSARRSSRTSLFSFKGRGRDIGSETE<br>FADDEHSIFGDNESRRGSLFVPHRPQERRSSNISQASRSPPMLPVNGKMHSAVD<br>CNGVVSLVDGRSALMLPNGQLLPEVIIDKATSDDSGTTNQIHKKRRCSSYLLSED<br>MLNDPNLRQRAMSRASILTNTVEELEESRQKCPPWWYRFAHKFLIWNCSPYWIK<br>FKKCIYFIVMDPFVDLAITICIVLNTLFMAMEHHPMTEEFKNVLAIGNLVFTGIFAA<br>EMVLKLIAMDPYEYFQVGWNIFDSLIVTLSLVELFLADVEGLSVLRSFRLLRVFKLA<br>KSWPTLNMLIKIIGNSVGALGNLTLVLAIIVFIFAVVGMQLFGKSYKECVCKINDDC<br>TLPRWHMNDFFHSFLIVFRVLCGEWIETMWDCMEVAGQAMCLIVYMMVMVI<br>GNLVVLNLFLALLLSSFSSDNLTAIEEDPDANNLQIAVTRIKKGINYVKQTLREFILKA<br>FSKKPKISREIRQAEDLNTKKENYISNHTLAEMSKGHNFLKEKDKISGFGSSVDKHL<br>MEDSDGQSFIHNPSLTVTVPIAPGESDLENMNAEELSSDSDSEYSKVRLNRSSSSE<br>CSTVDNPLPGEGEEAEAEPMNSDEPEACFTDGCVWRFSCCQVNIESGKGKIWW<br>NIRKTCYKIVEHSWFESFIVLMILLSSGALAFEDIYIERKKTIKIILEYADKIFTYIFILEM<br>LLKWIAYGYKTYFTNAWCWLDFLIVDVSLVTLVANTLGYSDLGPIKSLRTLRALRPL<br>RALSRFEGMRVVVNALIGAIPSIMNVLLVCLIFWLIFSIMGVNLFAGKFYECINTTD<br>GSRFPASQVPNRSECFALMNVSQNVRWKNLKVNFDNVGLGYLSLLQVATFKGW<br>TIIMYAAVDSVNVDKQPKYEYSLYMYIYFVVFIIFGSFFTLNLFIGVIIDNFNQQKKK<br>LGGQDIFMTEEQKKYYNAMKKLGSKKPQKPIPRPGNKIQGCIFDLVTNQAFDISI<br>MVLICLNMVTMMVEKEGQSQHMTEVLYWINVVFIILFTGECVLKLISLRHYYFTV<br>GWNIFDFVVVIISIVGMFLADLIETYFVSPTLFRVIRLARIGRILRLVKGAKGIRTLLFA<br>LMMSLPALFNIGLLLFLVMPIYAIFGMSNFAYVKKEDGINDMFNFETFGNSMICLF<br>QITTSAGWDGLLAPILNSKPPDCDPKKVHPGSSVEGDCGNPSVGIFYFVSYIIISFLV<br>VVNMYIAVILENFSVATEESTEPLSEDDFEMFYEVWEKFDPDATQFIEFSKLSDFA<br>AALDPPLLIAKPNKVQLIAMDLPMVSGDRIHCLDILFAFTKRVLGESGEMDSLRSQ<br>MEERFMSANPSKVSYEPITTTLKRKQEDVSATVIQRAYRRYRLRQNVKNISSIYIKD<br>GDRDDDLLNKKDMAFDNVNENSSPEKTDATSSTTSPPSYDSVTKPDKEKYEQDR<br>TEKEDKGKDSKESKK |
| 76 | HUMAN Nav1.7 NUCLEOTIDE SEQUENCE (ENST00000303354) | ATGGCAATGTTGCCTCCCCCAGGACCTCAGAGCTTTGTCCATTTCACAAAACA<br>GTCTCTTGCCCTCATTGAACAACGCATTGCTGAAAGAAAATCAAAGGAACCCA<br>AAGAAGAAAAGAAAGATGATGATGAAGAAGCCCCAAAGCCAAGCAGTGACT<br>TGGAAGCTGGCAAACAGCTGCCCTTCATCTATGGGGACATTCCTCCCGGCATG<br>GTGTCAGAGCCCCTGGAGGACTTGGACCCCTACTATGCAGACAAAAAGACTTT<br>CATAGTATTGAACAAAGGGAAACAATCTTCCGTTTCAATGCCACACCTGCTTT<br>ATATATGCTTTCTCCTTTCAGTCCTCTAAGAAGAATATCTATTAAGATTTTAGTA<br>CACTCCTTATTCAGCATGCTCATCATGTGCACTATTCTGACAAACTGCATATTT<br>ATGACCATGAATAACCCACCGGACTGGACCAAAATGTCGAGTACACTTTTAC<br>TGGAATATATACTTTTGAATCACTTGTAAAAATCCTTGCAAGAGGCTTCTGTGT<br>AGGAGAATTCACTTTTCTTCGTGACCCGTGGAACTGGCTGGATTTTGTCGTCA<br>TTGTTTTTGCGTATTTAACAGAATTTGTAAACCTAGGCAATGTTTCAGCTCTTC<br>GAACTTTCAGAGTATTGAGAGCTTTGAAAACTATTTCTGTAATCCCAGGCCTG<br>AAGACAATTGTAGGGGCTTTGATCCAGTCAGTGAAGAAGCTTTCTGATGTCAT<br>GATCCTGACTGTGTTCTGTCTGAGTGTGTTTGCACTAATTGGACTACAGCTGTT<br>CATGGGAAACCTGAAGCATAAATGTTTTCGAAATTCACTTGAAAATAATGAAA<br>CATTAGAAAGCATAATGAATACCCTAGAGAGTGAAGAAGACTTTAGAAAATA<br>TTTTTATTACTTGGAAGGATCCAAAGATGCTCTCCTTTGTGGTTTCAGCACAGA<br>TTCAGGTCAGTGTCCAGAGGGGTACACCTGTGTGAAAATTGGCAGAAACCCT<br>GATTATGGCTACACGAGCTTTGACACTTTCAGCTGGGCCTTCTTAGCCTTGTTT<br>AGGCTAATGACCCAAGATTACTGGGAAAACCTTTACCAACAGACGCTGCGTG<br>CTGCTGGCAAAACCTACATGATCTTCTTTGTCGTAGTGATTTTCCTGGGCTCCT<br>TTTATCTAATAAACTTGATCCTGGCTGTGGTTGCCATGGCATATGAAGAACAG<br>AACCAGGCAAACATTGAAGAAGCTAAACAGAAAGAATTAGAATTTCAACAGA<br>TGTTAGACCGTCTTAAAAAAGAGCAAGAAGAAGCTGAGGCAATTGCAGCGGC<br>AGCGGCTGAATATACAAGTATTAGGAGAAGCAGAATTATGGGCCTCTCAGAG<br>AGTTCTTCTGAAACATCCAAACTGAGCTCTAAAAGTGCTAAAGAAGAAGAAC<br>AGAAGAAAGAAAAAGAATCAAAAGAAGCTCTCCAGTGGAGAGGAAAAGGGA<br>GATGCTGAGAAATTGTCGAAATCAGAATCAGCATCAGAAGAAAA<br>AGTTTCCACCTTGGTGTCGAAGGGCATAGGCGAGCACATGAAAAGAGGTTGT<br>CTACCCCCAATCAGTCACCACTCAGCATTCGTGGCTCCTTGTTTTCTGCAAGGC<br>GAAGCAGCAGAACAAGTCTTTTTAGTTTCAAAGGCAGAGGAAGAGATATAGG<br>ATCTGAGACTGAATTTGCCGATGATGAGCACAGCATTTTTGGAGACAATGAA<br>AGCAGAAGGGGCTCACTGTTTGTGCCCCACAGACCCCAGGAGCGACGCAGCA<br>GTAACATCAGCCAAGCCAGTAGGTCCCCACCAATGCTGCCGGTGAACGGGAA<br>AATGCACAGTGCTGTGGACTGCAACGGTGTGGTCTCCCTGGTTGATGGACGC<br>TCAGCCCTCATGCTCCCCAATGGACAGCTTCTGCCAGAGGTGATAATAGATAA<br>GGCAACTTCTGATGACAGCGGCACGACCAATCAAATACACAAGAAAAGGCGT<br>TGTAGTTCCTATCTCCTTTCAGAGGATATGCTGAATGATCCCAACCTCAGACAG<br>AGAGCAATGAGTAGAGCAAGCATATTAACAAACACTGTGGAAGAACTTGAAG<br>AGTCCAGACAAAAATGTCCACCTTGGTGGTACAGATTTGCACACAAATTCTTG<br>ATCTGGAATTGCTCTCCATATTGGATAAAATTCAAAAGTGTATCTATTTTATT |

TABLE 10-continued

FURTHER SEQUENCES

| SEQ ID NO: | Human Allele | Nucleotide/Amino Acid Sequence |
|---|---|---|
| | | GTAATGGATCCTTTTGTAGATCTTGCAATTACCATTTGCATAGTTTTAAACACA<br>TTATTTATGGCTATGGAACACCACCCAATGACTGAGGAATTCAAAAATGTACT<br>GCTATAGGAAATTTGGTCTTTACTGGAATCTTTGCAGCTGAAATGGTATTAAA<br>ACTGATTGCCATGGATCCATATGAGTATTTCCAAGTAGGCTGGAATATTTTTG<br>ACAGCCTTATTGTGACTTTAAGTTTAGTGGAGCTCTTTCTAGCAGATGTGGAA<br>GGATTGTCAGTTCTGCGATCATTCAGACTGCTCCGAGTCTTCAAGTTGGCAAA<br>ATCCTGGCCAACATTGAACATGCTGATTAAGATCATTGGTAACTCAGTAGGGG<br>CTCTAGGTAACCTCACCTTAGTGTTGGCCATCATCGTCTTCATTTTTGCTGTGG<br>TCGGCATGCAGCTCTTTGGTAAGAGCTACAAAGAATGTGTCTGCAAGATCAAT<br>GATGACTGTACGCTCCCACGGTGGCACATGAACGACTTCTTCCACTCCTTCCTG<br>ATTGTGTTCCGCGTGCTGTGTGGAGAGTGGATAGAGACCATGTGGGACTGTA<br>TGGAGGTCGCTGGTCAAGCTATGTGCCTTATTGTTTACATGATGGTCATGGTC<br>ATTGGAAACCTGGTGGTCCTAAACCTATTTCTGGCCTTATTATTGAGCTCATTT<br>AGTTCAGACAATCTTACAGCAATTGAAGAAGACCCTGATGCAAACAACCTCCA<br>GATTGCAGTGACTAGAATTAAAAAGGGAATAAATTATGTGAAACAAACCTTA<br>CGTGAATTTATTCTAAAAGCATTTTCCAAAAAGCCAAAGATTTCCAGGGAGAT<br>AAGACAAGCAGAAGATCTGAATACTAAGAAGGAAAACTATATTTCTAACCAT<br>ACACTTGCTGAAATGAGCAAAGGTCACAATTTCCTCAAGGAAAAAGATAAAA<br>TCAGTGGTTTTGGAAGCAGCGTGGACAAACACTTGATGGAAGACAGTGATGG<br>TCAATCATTTATTCACAATCCCAGCCTCACAGTGACAGTGCCAATTGCACCTGG<br>GGAATCCGATTTGGAAAATATGAATGCTGAGGAACTTAGCAGTGATTCGGAT<br>AGTGAATACAGCAAAGTGAGATTAAACCGGTCAAGCTCCTCAGAGTGCAGCA<br>CAGTTGATAACCCTTTGCCTGGAGAAGGAGAAGAAGCAGAGGCTGAACCTAT<br>GAATTCCGATGAGCCAGAGGCCTGTTTCACAGATGGTTGTGTATGGAGGTTCT<br>CATGCTGCCAAGTTAACATAGAGTCAGGGAAAGGAAAAATCTGGTGGAACAT<br>CAGGAAAACCTGCTACAAGATTGTTGAACACAGTTGGTTTGAAAGCTTCATTG<br>TCCTCATGATCCTGCTCAGCAGTGGTGCCCTGGCTTTTGAAGATATTTATATTG<br>AAAGGAAAAAGACCATTAAGATTATCCTGGAGTATGCAGACAAGATCTTCACT<br>TACATCTTCATTCTGGAAATGCTTCTAAAATGGATAGCATATGGTTATAAAACA<br>TATTTCACCAATGCCTGGTGTTGGCTGGATTTCCTAATTGTTGATGTTTCTTTG<br>GTTACTTTAGTGGCAAACACTCTTGGCTACTCAGATCTTGGCCCCATTAAATCC<br>CTTCGGACACTGAGAGCTTTAAGACCTCTAAGAGCCTTATCTAGATTTGAAGG<br>AATGAGGGTCGTTGTGAATGCACTCATAGGAGCAATTCCTTCCATCATGAATG<br>TGCTACTTGTGTGTCTTATATTCTGGCTGATATTCAGCATCATGGGAGTAAATT<br>TGTTTGCTGGCAAGTTCTATGAGTGTATTAACACCACAGATGGGTCACGGTTT<br>CCTGCAAGTCAAGTTCCAAATCGTTCCGAATGTTTTGCCCTTATGAATGTTAGT<br>CAAAATGTGCGATGGAAAAACCTGAAAGTGAACTTTGATAATGTCGGACTTG<br>GTTACCTATCTCTGCTTCAAGTTGCAACTTTTAAGGGATGGACGATTATTATGT<br>ATGCAGCAGTGGATTCTGTTAATGTAGACAAGCAGCCCAAATATGAATATAGC<br>CTCTACATGTATATTTATTTTGTCGTCTTTATCATCTTTGGGTCATTCTTCACTTT<br>GAACTTGTTCATTGGTGTCATCATAGATAATTTCAACCAACAGAAAAAGAAGC<br>TTGGAGGTCAAGACATCTTTATGACAGAAGAACAGAAGAAATACTATAATGC<br>AATGAAAAAGCTGGGGTCCAAGAAGCCACAAAAGCCAATTCCTCGACCAGGG<br>AACAAAATCCAAGGATGTATATTTGACCTAGTGACAAATCAAGCCTTTGATAT<br>TAGTATCATGGTTCTTATCTGTCTCAACATGGTAACCATGATGGTAGAAAAGG<br>AGGGTCAAAGTCAACATATGACTGAAGTTTTATATTGGATAAATGTGGTTTTT<br>ATAATCCTTTTCACTGGAGAATGTGTGCTAAAACTGATCTCCCTCAGACACTAC<br>TACTTCACTGTAGGATGGAATATTTTTGATTTTGTGGTTGTGATTATCTCCATT<br>GTAGGTATGTTTCTAGCTGATTTGATTGAAACGTATTTTGTGTCCCCTACCCTG<br>TTCCGAGTGATCCGTCTTGCCAGGATTGGCCGAATCCTACGTCTAGTCAAAGG<br>AGCAAAGGGGATCCGCACGCTGCTCTTTGCTTTGATGATGTCCCTTCCTGCGT<br>TGTTTAACATCGGCCTCCTGCTCTTCCTGGTCATGTTCATCTACGCCATCTTTGG<br>AATGTCCAACTTTGCCTATGTTAAAAAGGAAGATGGAATTAATGACATGTTCA<br>ATTTTGAGACCTTTGGCAACAGTATGATTTGCCTGTTCCAAATTACAACCTCTG<br>CTGGCTGGGATGGATTGCTAGCACCTATTCTTAACAGTAAGCCACCCGACTGT<br>GACCCAAAAAAGTTCATCCTGGAAGTTCAGTTGAAGGAGACTGTGGTAACC<br>CATCTGTTGGAATATTCTACTTTGTTAGTTATATCATCATATCCTTCCTGGTTGT<br>GGTGAACATGTACATTGCAGTCATACTGGAGAATTTTAGTGTTGCCACTGAAG<br>AAAGTACTGAACCTCTGAGTGAGGATGACTTTGAGATGTTCTATGAGGTTTGG<br>GAGAAGTTTGATCCCGATGCGACCCAGTTTATAGAGTTCTCTAAACTCTCTGA<br>TTTTGCAGCTGCCCTGGATCCTCCTCTTCTCATAGCAAAACCCAACAAAGTCCA<br>GCTCATTGCCATGGATCTGCCCATGGTTAGTGGTGACCGGATCCATTGTCTTG<br>ACATCTTATTTGCTTTTACAAAGCGTGTTTTGGGTGAGAGTGGGGAGATGGAT<br>TCTCTTCGTTCACAGATGGAAGAAAGGTTCATGTCTGCAAATCCTTCCAAAGT<br>GTCCTATGAACCCATCACAACCACACTAAAACGGAAACAAGAGGATGTGTCT<br>GCTACTGTCATTCAGCGTGCTTATAGACGTTACCGCTTAAGGCAAAATGTCAA<br>AAATATATCAAGTATATACATAAAAGATGGAGACAGAGATGATGATTTACTCA<br>ATAAAAAGATATGGCTTTTGATAATGTTAATGAGAACTCAAGTCCAGAAAAA<br>ACAGATGCCACTTCATCCACCACCTCTCCACCTTCATATGATAGTGTAACAAAG<br>CCAGACAAAGAGAAATATGAACAAGACAGAACAGAAAAGGAAGACAAAGGG<br>AAAGACAGCAAGGAAAGCAAAAAATAG |

TABLE 11

Human IL4Ra variants distributed over several human ethnic populations & having desired total human genotype frequency (a) Amino acid variability, population distributions and frequencies:

|  |  | Human Populations | No. Indvids[1] | No. Unique Pops[2] | Het Freq[3] | Hom Freq[4] (Het + Hom freq[5]) | Cum Freq[6] |
|---|---|---|---|---|---|---|---|
| Most common | 75I |  | 835 |  | 0.462 | 0.302 (0.764) | 0.533 |
| Variant | 75V | ASW, CEU, CHB, CHS, CLM, FIN, GBR, IBS, JPT, LWK, MXL, PUR, TSI, YRI | 762 | 14 | 0.462 | 0.235 (0.697) | 0.467 |
| Most common | 400E |  | 988 |  | 0.256 | 0.648 (0.904) | 0.777 |
| Variant | 400A | ASW, CEU, CHB, CHS, CLM, FIN, GBR, IBS, JPT, LWK, MXL, PUR, TSI, YRI | 384 | 14 | 0.256 | 0.095 (0.351) | 0.223 |
| Most common | 431C |  | 1077 |  | 0.176 | 0.810 (0.986) | 0.898 |
| Variant | 431R | ASW, CEU, CHB, CHS, CLM, FIN, GBR, IBS, JPT, LWK, MXL, PUR, TSI, YRI | 207 | 14 | 0.176 | 0.014 (0.19) | 0.102 |
| Most common | 503S |  | 1010 |  | 0.269 | 0.656 (0.925) | 0.79 |
| Variant | 503P | ASW, CEU, CHB, CHS, CLM, FIN, GBR, IBS, JPT, LWK, MXL, PUR, TSI, YRI | 376 | 14 | 0.269 | 0.075 (0.344) | 0.21 |
| Most common | 576Q |  | 885 |  | 0.311 | 0.499 (0.81) | 0.655 |
| Variant | 576R | ASW, CEU, CHB, CHS, CLM, FIN, GBR, IBS, JPT, LWK, MXL, PUR, TSI, YRI | 547 | 14 | 0.311 | 0.190 (0.501) | 0.345 |
| Most common | 752S |  | 1059 |  | 0.176 | 0.794 (0.97) | 0.882 |
| Variant | 752A | ASW, CEU, CHB, CHS, CLM, FIN, GBR, IBS, JPT, LWK, MXL, PUR, TSI, YRI | 225 | 14 | 0.176 | 0.030 (0.206) | 0.118 |

Table Footnotes:
[1] Number of individuals in 1000 Genomes database (20110521) found to have the allele;
[2] Number of unique human ethnic populations in 1000 Genomes database in which the allele was found to occur;
[3] Heterozygous human genotype frequency, ie, cumulative frequency of all genotypes having one occurrence of the variant allele and one occurrence of another allele (heterozygous state), eg, ac genotype in 1000 Genomes database;
[4] Homozygous human genotype frequency, ie, cumulative frequency of two occurrences of the variant allele (homozygous state), eg, cc genotype in 1000 Genomes database; and
[5] Total human genotype frequency, ie, total of heterozygous plus homozygous human genotype frequencies.
[6] Cumulative human allele frequency of all occurrences of the variant allele in 1000 Genomes database.

(b) Nucleotide Sequence Variations of Selected Alleles

| Common Allele | A | A | T | T | A | T |
|---|---|---|---|---|---|---|
| Nucleotide Position[1] | 16:27344882 | 16:27362551 | 16:27362643 | 16:27362859 | 16:27363079 | 16:27363606 |
| Non-Synonymous Nucleotide Variation[2] | G | C | C | C | G | G |
| Variant ID[3] | rs1805010 | rs1805011 | rs1805012 | rs1805015 | rs1801275 | rs1805016 |
| Corresponding Amino Acid Variation |  |  |  |  |  |  |
| Variant Allele | 75V | 400A | 431R | 503P | 576R | 752A |

Table Footnotes:
[1] Notation is chromosome number (all positions are on human chromosome 1): coordinate number (Ensembl release 73 - September 2013, Genome assembly: GRCh37 (GCA_000001405.13), (forward strand);
[2] Nucleotide change (compared to most common allele) giving rise to an amino acid change in the variant form (compared to most common allele); and
[3] NCBI dbSNP reference number (NCBI dbSNP Build 138 released on Apr. 25, 2013).

TABLE 12

Human Nav1.7 (SCN9A) variants distributed over several human ethnic populations & having desired total human genotype frequency (a) Amino acid variability, population distributions and frequencies:

| | | Human Populations | No. Individs[1] | No. Unique Pops[2] | Het Freq[3] | Hom Freq[4] (Het + Hom freq[5]) | Cum Freq[6] |
|---|---|---|---|---|---|---|---|
| colspan=8 | VARIANTS ASSOCIATED WITH PRIMARY ERYTHERMALGIA (PE)[7] |
| Most common | 136V | | | | | | |
| Variant | 136I | | | | | | |
| Most common | 216F | | | | | | |
| Variant | 216S | | | | | | |
| Most common | 241S | | | | | | |
| Variant | 241T | | | | | | |
| Most common | 395N | | | | | | |
| Variant | 395K | | | | | | |
| Most common | 848I | | | | | | |
| Variant | 848T | | | | | | |
| Most common | 858L | | | | | | |
| Variant | 858H | | | | | | |
| | 858F | | | | | | |
| Most common | 863A | | | | | | |
| Variant | 863P | | | | | | |
| Most common | 1449F | | | | | | |
| Variant | 1449V | | | | | | |
| colspan=8 | VARIANTS ASSOCIATED WITH PAROXYSMAL EXTREME PAIN DISORDER (PEPD)[7] |
| Most common | 996R | | | | | | |
| Variant | 996C | | | | | | |
| Most common | 1298V | | | | | | |
| Variant | 1298F | | | | | | |
| | 1298D | | | | | | |
| Most common | 1299V | | | | | | |
| Variant | 1299F | | | | | | |
| Most common | 1461I | | | | | | |
| Variant | 1461T | | | | | | |
| Most common | 1462F | | | | | | |
| Variant | 1462V | | | | | | |
| Most common | 1464T | | | | | | |
| Variant | 1464I | | | | | | |
| Most common | 1627M | | | | | | |
| Variant | 1627K | | | | | | |
| colspan=8 | VARIANTS ASSOCIATED WITH CHANNELOPATHY-ASSOCIATED INSENSITIVITY TO PAIN (CIP)[7] |
| Most common | 277R | | | | | | |
| Variant | 277X[8] | | | | | | |
| Most common | 328Y | | | | | | |
| Variant | 328X | | | | | | |
| Most common | 395N | | | | | | |
| Variant | 395K | | | | | | |
| Most common | 459S | | | | | | |
| Variant | 459X | | | | | | |
| Most common | 693E | | | | | | |
| Variant | 693X | | | | | | |
| Most common | 767I | | | | | | |
| Variant | 767X | | | | | | |
| Most | 830R | | | | | | |

TABLE 12-continued

Human Nav1.7 (SCN9A) variants distributed over several human ethnic populations & having desired total human genotype frequency

| | | | | | | |
|---|---|---|---|---|---|---|
| Most common | 830X | | | | | |
| Variant | 897W | | | | | |
| Most common | 897X | | | | | |
| Variant | 1200F | | | | | |
| Most common | 1200L | | | | | |
| Variant | 1235I | | | | | |
| Most common | 1235L | | | | | |
| Variant | 1488R | | | | | |
| Most common | 1488X | | | | | |
| Variant | 1659K | | | | | |
| Most common | 1659X | | | | | |
| Variant | 1689W | | | | | |
| Most common | 1689X | | | | | |
| FURTHER VARIANTS | | | | | | |
| Most common | 422E | | 962 | | 0.442 | 0.439 (0.881) | 0.660 |
| Variant | 422D | ASW, CEU, CHB, CHS, CLM, FIN, GBR, IBS, JPT, LWK, MXL, PUR, TSI, YRI | 613 | 14 | 0.442 | 0.119 (0.561) | 0.340 |
| Most common | 490S | | 1086 | | 0.076 | 0.918 (0.994) | 0.957 |
| Variant | 490N | ASW, CEU, CHB, CHS, CLM, FIN, GBR, IBS JPT, LWK, MXL, PUR, TSI, YRI | 89 | 14 | 0.076 | 0.005 (0.081) | 0.043 |
| Most common | 943M | | | | | | |
| Variant | 943L | ASW, CEU, CHB, CHS, CLM, FIN, GBR, IBS, JPT, LWK, MXL, PUR, TSI, YRI | | 14 | | | |
| Most common | 1161R | | 1076 | | 0.189 | 0.797 (0.986) | 0.891 |
| Variant | 1161W | ASW, CEU, CHB, CHS, CLM, FIN, GBR, IBS, JPT, LWK, MXL, PUR, TSI, YRI | 222 | 14 | 0.189 | 0.015 (0.204) | 0.109 |
| Most common | 1919D | | 1076 | | 0.109 | 0.876 (0.985) | 0.931 |
| Variant | 1919G | ASW, CEU, CHB, CHS, CLM, FIN, GBR, IBS, JPT, LWK, MXL, PUR, TSI, YRI | 135 | 14 | 0.109 | 0.015 (0.124) | 0.069 |

Table Footnotes:
[1]Number of individuals in 1000 Genomes database (20110521) found to have the allele;
[2]Number of unique human ethnic populations in 1000 Genomes database in which the allele was found to occur;
[3]Heterozygous human genotype frequency, ie, cumulative frequency of all genotypes having one occurrence of the variant allele and one occurrence of another allele (heterozygous state), eg, ac genotype in 1000 Genomes database;
[4]Homozygous human genotype frequency, ie, cumulative frequency of two occurrences of the variant allele (homozygous state), eg, cc genotype in 1000 Genomes database; and
[5]Total human genotype frequency, ie, total of heterozygous plus homozygous human genotype frequencies.
[6]Cumulative human allele frequency of all occurrences of the variant allele in 1000 Genomes database.
[7]See J Clin Invest. 2007 December; 117(12):3603-9, "Mutations in sodium-channel gene SCN9A cause a spectrum of human genetic pain disorders", Drenth JP & Waxman SG (incorporated herein by reference); amino acid position numbering is as per this reference.
[8]X here and elsewhere indicate change to an unknown amino acid (ie, a change from the most common amino acid at that position) Amino acid positions are as per Ensembl, unless otherwise indicated.

TABLE 12-continued

| Human Nav1.7 (SCN9A) variants distributed over several human ethnic populations & having desired total human genotype frequency | | | | | | |
|---|---|---|---|---|---|---|
| (b) Nucleotide Sequence Variations of Selected Alleles | | | | | | |
| Common Allele | G | T | C | C | T | T |
| | Nucleotide Position[1] | | | | | |
| | 2:166242648 | 2:166198883 | 2:166286469 | 2:166272746 | 2:166288485 | 2:166277030 |
| | Non-Synonymous Nucleotide Variation[2] | | | | | |
| | A | C | T | A | C | G |
| | Variant ID[3] | | | | | |
| | rs6746030 | rs3750904 | rs58022607 | rs4369876 | rs13402180 | rs12478318 |
| | Corresponding Amino Acid Variation | | | | | |
| Variant Allele | 1161W | 1919G | 490N | 1002L | 422D | 943L |

Table Footnotes:
[1]Notation is chromosome number (all positions are on human chromosome 1): coordinate number (Ensembl release 73 - September 2013, Genome assembly: GRCh37 (GCA_000001405.13), (forward strand);
[2]Nucleotide change (compared to most common allele) giving rise to an amino acid change in the variant form (compared to most common allele); and
[3]NCBI dbSNP reference number (NCBI dbSNP Build 138 released on Apr. 25, 2013).

Example 4

Rarer IL6R Variants

The present invention provides anti-IL6R ligands; and IL6R-binding or targeting ligands as described herein. The ligands have a variety of utilities. Some of the ligands, for instance, are useful in specific binding assays, for genotyping or phenotyping humans, affinity purification of IL6R, in particular human IL6R or its ligands and in screening assays to identify other antagonists of IL6R activity. Some of the ligands of the invention are useful for inhibiting binding of IL6R to IL6 and/or gp130, or inhibiting IL6R-mediated activities.

Anti-IL6R ligands (eg, antibodies and anti-sense RNA) have been developed based on targeting and neutralising so-called “wild-type” human IL6R, which is a commonly-occurring form (see, eg, SEQ ID NO: 78). While such therapies are useful for human patients harbouring this form of human IL6R, the inventor considered it useful to investigate the possibility of targeting rarer—but still naturally-occurring—forms of IL6R amongst human populations. In this way, the inventor arrived at insight into the natural occurrences and distributions of rarer human IL6R forms that can serve as useful targets (at the protein or nucleic acid level) for human treatment, prophylaxis and diagnosis pertinent to diseases and conditions mediated or associated with IL6R activity. This particularly provides for tailored therapies, prophylaxis and diagnosis in humans that are devoid of the common IL6R gene or protein.

The skilled person will know that SNPs or other changes that translate into amino acid variation can cause variability in activity and/or conformation of human targets to be addressed. This has spawned great interest in personalized medicine where genotyping and knowledge of protein and nucleotide variability is used to more effectively tailor medicines and diagnosis of patients. The invention, therefore, provides for tailored pharmaceuticals and testing that specifically addresses rarer IL6R polymorphic variant forms. Such forms or “alleles” (at the nucleotide level), comprise one or more changes at the nucleotide and amino acid levels from the corresponding common form nucleotide and amino acids sequences, ie, there are one or more non-synonymous changes at the nucleotide level that translate into one or more corresponding changes in the protein target in humans.

Furthermore, the inventor surprisingly realised that the rarer natural forms, although present in humans at much lower frequencies than the common form, nevertheless are represented in multiple and ethnically-diverse human populations and usually with many human examples per represented ethnic population. Thus, the inventor realised that targeting such rarer forms would provide for effective treatment, prophylaxis or diagnosis across many human ethnic populations, thereby extending the utility of the present invention.

With this realisation, the inventor realised that there is significant industrial and medical application for the invention in terms of guiding the choice of anti-IL6R ligand for administration to human patients for therapy and/or prophylaxis of IL6R-mediated or associated diseases or conditions. In this way, the patient receives drugs and ligands that are tailored to their needs—as determined by the patient’s genetic or phenotypic makeup. Hand-in-hand with this, the invention provides for the genotyping and/or phenotyping of patients in connection with such treatment, thereby allowing a proper match of drug to patient. This increases the chances of medical efficacy, reduces the likelihood of inferior treatment using drugs or ligands that are not matched to the patient (eg, poor efficacy and/or side-effects) and avoids pharmaceutical mis-prescription and waste.

In developing this thinking, in this non-limiting example the present inventor decided to determine a set of human IL6R variants on the basis of the following criteria, these being criteria that the inventor realised would provide for useful medical drugs and diagnostics to tailored need in the human population. The inventor selected variants having at least 3 of the 4 following criteria:—Naturally-occurring human IL6R variation having a cumulative human allele frequency of 35% or less;

- Naturally-occurring human IL6R variation having a total human genotype frequency of about 50% or less;
- Naturally-occurring human IL6R variation found in many different human ethnic populations (using the standard categorisation of the 1000 Genomes Project; see Table 14 below); and Naturally-occurring human IL6R variation found in many individuals distributed across such many different ethnic populations.

On the basis of these criteria, the inventor identified the variants listed in Table 13 below. The inventor's selection included, as a consideration, selection for nucleotide variation that produced amino acid variation in corresponding IL6R forms (ie, non-synonymous variations), as opposed to silent variations that do not alter amino acid residues in the target protein.

ligands comprising antibody VH domains derived from recombination of human IGHV gene segments comprising selected nucleotides at positions in the HCDR1 or FW3 where there is variability in humans (ie, where SNPs occur in humans).

The inventor analysed human IGHV variation and used this to choose ligands based on human IGHV alleles comprising said selected nucleotides and for matching to human recipient genotypes and/or phenotypes. The inventor identified utility in using gene VH gene segments encoding (i) a CDR1 com-

TABLE 13

Human IL6R variants distributed over several human ethnic populations & having desired total human genotype frequency (a) Amino acid variability, population distributions and frequencies: Exon 9

| | | Human Populations | No. Individs[1] | No. Unique Pops[2] | Het Freq[3] | Hom Freq[4] (Het + Hom freq[5]) | Cum Freq[6] |
|---|---|---|---|---|---|---|---|
| Most common | 358D | | | | 0.383 | 0.489 (0.872) | 0.680 |
| Variant | 358A | YRI, ASW, GBR, TSI, CLM, CHB, LWK, CHS, MXL, PUR, JPT, IBS, FIN, CEU (See note 7) | 557 | 14 | 0.383 | 0.128 (0.511) | 0.320 |
| Most common | 385V | | | | 0.086 | 0.904 (0.99) | 0.947 |
| Variant | 385I | LWK, ASW, YRI, PUR (see note 8) | 105 | 4 | 0.086 | 0.010 (0.096) | 0.053 |

Table Footnotes:
[1]Number of individuals in 1000 Genomes database (20110521) found to have the allele;
[2]Number of unique human ethnic populations in 1000 Genomes database in which the allele was found to occur;
[3]Heterozygous human genotype frequency, ie, cumulative frequency of all genotypes having one occurrence of the variant allele and one occurrence of another allele (heterozygous state), eg, ac genotype in 1000 Genomes database;
[4]Homozygous human genotype frequency, ie, cumulative frequency of two occurrences of the variant allele (homozygous state), eg, cc genotype in 1000 Genomes database; and
[5]Total human genotype frequency, ie, total of heterozygous plus homozygous human genotype frequencies.
[6]Cumulative human allele frequency of all occurrences of the variant allele in 1000 Genomes database.
[7]According to the 1000 Genomes database version 20130502, this variant is found in the following 26 human populations (KHV, GBR, CHB, CDX, CLM, MXL, CHS, JPT, GIH, PUR, ESN, FIN, ACB, BEB, YRI, ASW, ITU, PJL, TSI, PEL, MSL, LWK, STU, GWD, IBS, CEU) and in 1218 individuals with a cumulative frequency of 0.29.
[8]According to the 1000 Genomes database version 20130502, this variant is found in the following 10 human populations (ASW, YRI, PEL, MSL, LWK, GWD, PUR, IBS, ESN, ACB) and in 267 individuals with a cumulative frequency of 0.06.

(b) Nucleotide Sequence Variations of Selected Alleles

| | | |
|---|---|---|
| Common Allele | A | G |
| | Nucleotide Position[1] | |
| Variant Allele | 1:154426970 | 1:154427050 |
| | Non Synonymous Nucleotide Variation[2] | |
| | C | A |
| | Variant ID[3] | |
| | rs2228145 | rs28730736 |
| | Corresponding Amino Acid Variation | |
| | 358A | 385I |

Table Footnotes:
[1]Notation is chromosome number (all positions are on human chromosome 1): coordinate number (Ensembl release 73 - September 2013, Genome assembly: GRCh37 (GCA_000001405.13);
[2]Nucleotide change (compared to most common allele) giving rise to an amino acid change in the variant form (compared to most common allele); and
[3]NCBI dbSNP reference number (NCBI dbSNP Build 138 released on Apr. 25, 2013).

Tailoring Antibodies to Rarer IL6R Variant Profile

As outlined above, the invention includes the possibility to tailor treatment of humans further by selecting antibody-based ligands with variable and/or constant domains based on gene segments found in many humans of the ethnic populations where the variant IL6R forms are found to meet the selection criteria of the invention. An example is provided for prising a Phe at position 4 shown in SEQ ID NO: 109 and wherein said human comprises a VH gene segment encoding a CDR1 comprising a Phe at position 4 shown in SEQ ID NO: 109, or the human expresses VH domains that comprise a CDR1 comprising a Phe at position 4 shown in SEQ ID NO: 109; or (ii) a FW3 comprising a Thr at position 33 shown in SEQ ID NO: 111 and wherein said human comprises a VH gene segment encoding a FW3 comprising a Thr at position 33 shown in SEQ ID NO: 111 or the human expresses VH domains that comprise a FW3 comprising a Thr at position 33 shown in SEQ ID NO: 111. Further information is provided in Table 14, which shows variation at these positions, as well as the variant distributions across the 1000 Genomes Project database relating to many human populations.

In other embodiments, as explained more fully above, the invention provides for ligands which are tailored to the human recipient's genotype and/or phenotype based on alternative human VH gene segments, or on Vκ, Vλ or constant region gene segments (see further Table 16 for representative variants).

In an example, following this guidance, the chosen ligand can be sarilumab.

Further examples, therefore are:—
(i) wherein the ligand comprises a VH domain derived from the recombination of human VH segment IGHV3-7*01, a human D gene segment and a human JH segment, and wherein said human comprises a IGHV3-7*01 VH gene segment or the human expresses VH domains derived from the recombination of human VH segment IGHV3-7*01, a human D gene segment and a human JH segment.
(ii) wherein the ligand comprises a Vκ domain derived from the recombination of human Vκ segment IGKV1-12*01 and a human Jκ segment, and wherein said human comprises a IGKV1-12*01 Vκ gene segment or the human expresses Vκ domains derived from the recombination of human Vκ segment IGKV1-12*01 and a human Jκ segment.
(iii) wherein the ligand comprises a Vκ domain derived from the recombination of a human Vκ segment and a human Jκ segment, the human Vκ segment encoding (i) a CDR3 comprising a Pro at position 7 shown in SEQ ID NO: 113 and wherein said human comprises a Vκ gene segment encoding a CDR3 comprising a Pro at position 7 shown in SEQ ID NO: 113, or the human expresses Vκ domains that comprise a CDR3 comprising a Pro at position 7 shown in SEQ ID NO: 113; or (ii) a FW3 comprising a Ser at position 15 shown in SEQ ID NO: 115 and wherein said human comprises a Vκ gene segment encoding a FW3 comprising a Ser at position 15 shown in SEQ ID NO: 115 or the human expresses Vκ domains that comprise a FW3 comprising a Ser at position 15 shown in SEQ ID NO: 115.
(iv) wherein the ligand comprises a human gamma-1 heavy chain constant region that comprises an Asp at position 204 shown in SEQ ID NO: 81 or a Leu at position 206 shown in SEQ ID NO: 81 and wherein said human comprises (i) an IGHG1*01 human heavy chain constant region gene segment, or the human expresses antibodies comprising human gamma-1 heavy chain constant regions comprising an Asp at position 204 shown in SEQ ID NO: 81 or a Leu at position 206 shown in SEQ ID NO: 81.
(v) wherein the ligand comprises a human gamma-2 heavy chain constant region that comprises an amino acid selected from the group consisting of a Pro at position 72 shown in SEQ ID NO: 83, an Asn at position 75 shown in SEQ ID NO: 83, a Phe at position 76 shown in SEQ ID NO: 83, a Val at position 161 shown in SEQ ID NO: 83 and an Ala at position 257 shown in SEQ ID NO: 83 and wherein said human comprises (i) an IGHG2*01 human heavy chain constant region gene segment, or the human expresses antibodies comprising human gamma-2 heavy chain constant regions comprising said selected Pro at position 72 shown in SEQ ID NO: 83, Asn at position 75 shown in SEQ ID NO: 83, Phe at position 76 shown in SEQ ID NO: 83, Val at position 161 shown in SEQ ID NO: 83 or Ala at position 257 shown in SEQ ID NO: 83.
(vi) wherein the ligand comprises a human kappa chain constant region that comprises a Val at position 84 shown in SEQ ID NO: 93 or a Cys at position 87 shown in SEQ ID NO: 93 and wherein said human comprises (i) an IGKC1*01 human kappa chain constant region gene segment, or the human expresses antibodies comprising human kappa chain constant regions comprising a Val corresponding to position 84 shown in SEQ ID NO: 93 or a Cys at position 87 shown in SEQ ID NO: 93.
(vii) wherein the ligand comprises a human IGLC1*01 lambda chain constant region and wherein said human comprises (i) a human IGLC1*01 lambda chain constant region gene segment, or the human expresses antibodies comprising human IGLC1*01 lambda chain constant regions.

For example, as per example (iv), the inventor identified the possibility of addressing the rarer IGH-gamma-1 SNPs 204D (observed cumulative frequency of 0.296) and 206L (observed cumulative frequency of 0.283) individually or in combination. These residues are part of the CH3 domain, and as such they form part of antibody Fc regions. Thus, matching of these CH3 variations with the patient is especially beneficial for reasons as discussed above. Thus, in this example the ligand of the invention comprises or consists of an antibody that comprises a human gamma-1 heavy chain constant region that comprises an Asp corresponding to position 204 of SEQ ID NO: 81 or a Leu corresponding to position 206 of SEQ ID NO: 81 and wherein the genome of the human comprises a gamma-1 heavy chain constant region nucleotide sequence that encodes such an Asp or Leu or the human expresses antibodies comprising human gamma-1 constant regions comprising such an Asp or Leu. An example of such a ligand is sarilumab.

In another example, as per example (v), the inventor identified the possibility of addressing IGH-gamma-2 SNPs. This included consideration of Fc region variation—in this respect, the inventor focused on positions 161 and 257 which are in the Fc region. Thus, in this example the ligand of the invention comprises or consists of an antibody that comprises a human gamma-2 heavy chain constant region that comprises an amino acid selected from the group consisting of a Pro corresponding to position 72 of SEQ ID NO: 83, an Asn corresponding to position 75 of SEQ ID NO: 83, a Phe corresponding to position 76 of SEQ ID NO: 83, a Val corresponding to position 161 of SEQ ID NO: 83 and an Ala corresponding to position 257 of SEQ ID NO: 83; and wherein the genome of the human comprises a gamma-2 heavy chain constant region nucleotide sequence that encodes such a selected amino acid or the human expresses antibodies comprising human gamma-2 constant regions comprising such a selected amino acid.

In another example, as per example (vi), the inventor addressed human kappa constant region variation. Thus, in this example the ligand of the invention comprises or consists of an antibody that comprises a human kappa light chain constant region that comprises a Val corresponding to position 84 of SEQ ID NO: 93 or a Cys corresponding to position 87 of SEQ ID NO: 93; and wherein the genome of the human comprises a kappa light chain constant region nucleotide sequence that encodes such a Val or Cys or the human expresses antibodies comprising human kappa light chain constant regions comprising such a Val or Cys. An example of such a ligand is sarilumab.

In another example, as per example (vii), the inventor addressed human lambda constant region variation. Thus, in this example the ligand of the invention comprises or consists of an antibody that comprises a human IGLC2*01 light chain constant region; and wherein the genome of the human comprises a human IGLC2*01 nucleotide sequence or the human expresses antibodies comprising human light chain IGLC2*01 constant regions.

Determination of Specific Binding of Ligands of the Invention to IL6R Variants

The specific binding of ligands of the invention to IL6R variants can be performed using the following method.

Method of SPR Determination of Binding

Binding of the antibodies to the IL6R variants is carried out by SPR using the ProteOn XPR36™ Array system (BioRad). An anti-human IgG surface (Jackson Labs 109-005-008) was created on a GLC Biosensor chip by primary amine coupling. Test antibodies are captured on this surface as ligands. The IL6R variants are used as analytes and passed over the captured antibodies at 256 nM, 64 nM, 16 nM, 4 nM and 1 nM. Binding curves are double referenced using a buffer injection (i.e. 0 nM) to remove baseline drift and injection artefacts. Regeneration of the capture surface is with 100 mM phosphoric acid which removes the captured antibody allowing another cycle of capture and binding. The binding sensorgrams generated are analysed using the 1:1 model inherent to the ProteOn XPR36 Array system analysis software. The assay is performed at 25° C. and using 1xHBS-EP (Teknova) as running buffer.

REFERENCES

The references cited herein are incorporated by reference in their entirety

1. Ferreira et al (PLoS Genet. 2013 April; 9(4):e1003444. doi: 10.1371/journal.pgen.1003444. Epub 2013 Apr. 4, "Functional IL6R 358Ala allele impairs classical IL-6 receptor signaling [sic] and influences risk of diverse in flammatory diseases"; Rantala A et al, Hum Immunol. 2011 January; 72(1):63-8. doi: 10.1016/j.humimm.2010.10.010. Epub 2010 Oct. 15, "Association of IL-6 and IL-6R gene polymorphisms with susceptibility to respiratory tract infections in young Finnish men";
2. Zhang H Y et al, Oral Dis. 2014 January; 20(1):69-75. doi: 10.1111/odi.12075. Epub 2013 Feb. 24, "The association of IL-6 and IL-6R gene polymorphisms with chronic periodontitis in a Chinese population";
3. J C Galicia et al, Genes and Immunity (2004) 5, 513-516. doi:10.1038/sj.gene.6364120 Published online 12 Aug. 2004, "Polymorphisms in the IL-6 receptor (IL-6R) gene: strong evidence that serum levels of soluble IL-6R are genetically influenced";
4. Esparza-Gordillo J et al, J Allergy Clin Immunol 2013 August; 132(2):371-7. doi: 10.1016/j.jaci.2013.01.057. Epub 2013 Apr. 9, "A functional IL-6 receptor (IL6R) variant is a risk factor for persistent atopic dermatitis".

TABLE 14

1000 GENOMES PROJECT HUMAN POPULATIONS
Below is a summary of the ethnic populations as per the 1000 Genomes Project sequences.

(a) 100 Genome Populations

| Population Code | Population Description | Super Population Code |
| --- | --- | --- |
| CHB | Han Chinese in Bejing, China | ASN |
| JPT | Japanese in Tokyo, Japan | ASN |
| CHS | Southern Han Chinese | ASN |
| CDX | Chinese Dai in Xishuangbanna, China | ASN |
| KHV | Kinh in Ho Chi Minh City, Vietnam | ASN |

TABLE 14-continued

1000 GENOMES PROJECT HUMAN POPULATIONS
Below is a summary of the ethnic populations as per the 1000 Genomes Project sequences.

| | | |
| --- | --- | --- |
| CEU | Utah Residents (CEPH) with Northern and Western European ancestry | EUR |
| TSI | Toscani in Italia | EUR |
| FIN | Finnish in Finland | EUR |
| GBR | British in England and Scotland | EUR |
| IBS | Iberian population in Spain | EUR |
| YRI | Yoruba in Ibadan, Nigeria | AFR |
| LWK | Luhya in Webuye, Kenya | AFR |
| GWD | Gambian in Western Divisons in The Gambia | AFR |
| MSL | Mende in Sierra Leone | AFR |
| ESN | Esan in Nigera | AFR |
| ASW | Americans of African Ancestry in SW USA | AFR |
| ACB | African Carribbeans in Barbados | AFR |
| MXL | Mexican Ancestry from Los Angeles USA | AMR |
| PUR | Puerto Ricans from Puerto Rico | AMR |
| CLM | Colombians from Medellin, Colombia | AMR |
| PEL | Peruvians from Lima, Peru | AMR |
| GIH | Gujarati Indian from Houston, Texas | SAN |
| PJL | Punjabi from Lahore, Pakistan | SAN |
| BEB | Bengali from Bangladesh | SAN |
| STU | Sri Lankan Tamil from the UK | SAN |
| ITU | Indian Telugu from the UK | SAN |

(b) Super Populations

AFR, African
AMR, Ad Mixed American
ASN, East Asian
EUR, European
SAN, South Asian (c) Population Ancestries European ancestry Utah residents (CEPH) with Northern and Western European ancestry (CEU)
Toscani in Italia (TSI)
British from England and Scotland (GBR)
Finnish from Finland (FIN)
Iberian populations in Spain (IBS)

East Asian ancestry

Han Chinese in Beijing, China (CHB)
Japanese in Toyko, Japan (JPT)
Han Chinese South (CHS)
Chinese Dai in Xishuangbanna (CDX)
Kinh in Ho Chi Minh City, Vietnam (KHV)
Chinese in Denver, Colorado (CHD) (pilot 3 only)

West African ancestry

Yoruba in Ibadan, Nigeria (YRI)
Luhya in Webuye, Kenya (LWK)
Gambian in Western Division, The Gambia (GWD)
Malawian in Blantyre, Malawi (MAB)
West African Population (TBD)

Americas

African Ancestry in Southwest US (ASW)
African American in Jackson, MS (AJM)
African Caribbean in Barbados (ACB)
Mexican Ancestry in Los Angeles, CA (MXL)
Puerto Rican in Puerto Rico (PUR)
Colombian in Medellin, Colombia (CLM)
Peruvian in Lima, Peru (PEL)

South Asian ancestry

Ahom in the State of Assam, India
Kayadtha in Calcutta, India
Reddy in Hyderabad, India
Maratha in Bombay, India
Punjabi in Lahore, Pakistan

TABLE 15

Exemplary anti-IL6R disclosures, eg of antibodies and/or antibody fragments, assays, treatments, formulations, kits, methods and indications, useful in any and all aspects of the invention Patent or patent application which is incorporated by reference in its entirety, and specifically, eg, with respect to the SEQ ID Nos. comprising an anti-IL6R monoclonal antibody or fragment thereof U.S. Pat. No. 8,568,721,
US20130157313A1,
US20130149310A1,
US20130122003A1,
U.S. Pat. No. 8,192,741,
U.S. Pat. No. 8,183,014,
US20120003697A1,

TABLE 15-continued

Exemplary anti-IL6R disclosures, eg of antibodies and/or antibody fragments, assays, treatments, formulations, kits, methods and indications, useful in any and all aspects of the invention Patent or patent application which is incorporated by reference in its entirety, and specifically, eg, with respect to the SEQ ID Nos. comprising an anti-IL6R monoclonal antibody or fragment thereof U.S. Pat. No. 8,080,248,
U.S. Pat. No. 8,043,617,
US20110171241A1,
US20100316636A1,
US20100316627A1,
U.S. Pat. No. 7,582,298

TABLE 16

Human antibody gene segment variants distributed over several human ethnic populations - useful for ligand tailoring

| Example Human Gene Segment Type | Example Human Allele[1] | Amino Acid Coordinate[2] & Variation | Nucleotide Variation[3] (NCB dbSNP reference number)[4] | Variant Nucleotide Position | Human Populations[5] | No. Individs[6] | Het Freq[7] | Hom Freq[8] (Het + Hom freq[9]) | Cum Freq[10] |
|---|---|---|---|---|---|---|---|---|---|
| IGHV3-9 | IGHV3-9*01 | 30F (IMGT numbering) (Phe at position 4 in SEQ ID NO: 32) (CDR1 variation) | TTT | | | | | | |
| | IGHV3-9*02 | 30S (IMGT numbering) (CDR1 variation) | TCT | | | | | | |
| | IGHV3-9*01 | 110T (Thr at position 33 in SEQ ID NO: 34) (FW3 variation) | ACG | 14:106552310 (forward strand) | B | 1015 | 0.082 | 0.847 (0.929) | 0.888 |
| | IGHV3-9*03 | 110M (FW3 variation) | ATG (rs8020204) | 14:106552310 (forward strand) | B | 167 | 0.082 | 0.071 (0.153) | 0.112 |
| IGKV3-11 | IGKV3-11*01 | 115P (Pro at position 7 in SEQ ID NO: 36) (CDR3 variation) | CCT | 2:89326669 (forward strand) | B | 1090 | 0.064 | 0.934 (0.998) | 0.966 |
| | | 115H (CDR3 variation) | CAT (rs182958807) | 2:89326669 (forward strand) | B | 72 | 0.064 | 0.002 (0.066) | 0.034 |
| | IGKV3-11*01 | 87S (Ser at position 15 in SEQ ID NO: 38) (FW3 variation) | TCT | 2:89326754 (forward strand) | B | 1090 | 0.074 | 0.924 (0.998) | 0.961 |
| | | 87P (FW3 variation) | CCT (rs191612627) | 2:89326754 (forward strand) | B | 83 | 0.074 | 0.002 (0.076) | 0.039 |
| IGKC | IGKC*01 | 84V (Val at position 84 in SEQ ID NO: 16) | GTC | 2:89156948 (forward strand) | B | 454 | 0.345 | 0.071 (0.416) | 0.243 |
| | IGKC*04 | 84L | CTC (rs232230) | 2:89156948 (forward strand) | B | 1015 | 0.345 | 0.584 (0.929) | 0.757 |
| | IGKC*01 | 87C (Cys at position 87 in SEQ ID NO: 16) | TGC | 2:89156939 (forward strand) | | | | | |
| | IGKC*02 | 87G | GGC (rs200765148) | 2:89156939 (forward strand) | | | | | |
| | IGHG1*01 | 204D (CH3 variation) | GAT | 14:106208086 (forward strand) | A (European ancestry) | 153 | 0.400 | 0.096 (0.496) | 0.296 |
| IGHG1 | IGHG1*03 | 204E (CH3 variation) | GAG (rs1045853) | 14:106208086 (forward strand) | A (European ancestry) | 366 | 0.400 | 0.504 (0.904) | 0.704 |
| | IGHG1*01 | 206L (CH3 variation) | CTG | 14:106208082 (forward strand) | A (European ancestry) | | 0.358 | 0.104 (0.462) | 0.283 |
| | IGHG1*03 | 206M (CH3 variation) | ATG (rs11621259) | 14:106208082 (forward strand) | A (European ancestry) | | 0.358 | 0.538 (0.896) | 0.717 |
| IGHG2 | IGHG2*01 | 72P (CH1 variation) | CCC | 14:106110914 (forward strand) | B | | 0.336 | 0.540 (0.876) | 0.708 |

TABLE 16-continued

Human antibody gene segment variants distributed over several human ethnic populations - useful for ligand tailoring

| Example Human Gene Segment Type | Example Human Allele[1] | Amino Acid Coordinate[2] & Variation | Nucleotide Variation[3] (NCB dbSNP reference number)[4] | Variant Nucleotide Position | Human Populations[5] | No. Individs[6] | Het Freq[7] | Hom Freq[8] (Het + Hom freq[9]) | Cum Freq[10] |
|---|---|---|---|---|---|---|---|---|---|
| | IGHG2*02 | 72T (CH1 variation) | ACC (rs11627594) | 14:106110914 (forward strand) | B | | 0.336 | 0.124 | 0.292 |
| | IGHG2*01 | 75N (CH1 variation) | AAC | 14:106110904 (forward strand) | A | | 0.007 | 0.993 | 0.997 |
| | IGHG2*04 | 75S (CH1 variation) | AGC (rs201590297) | 14:106110904 (forward strand) | A | | 0.007 | | 0.004 |
| | IGHG2*01 | 76F (CH1 variation) | TTC | | | | | | |
| | IGHG2*04 | 76L (CH1 variation) | TTG | | | | | | |
| | IGHG2*01 | 161V (CH2 variation) | GTG | 14:10611013 (forward strand) | B | | 0.342 | 0.539 (0.881) | 0.711 |
| | IGHG2*02 | 161M (CH2 variation) | ATG (rs8009156) | 14:10611013 (forward strand) | B | | 0.342 | 0.118 (0.46) | 0.289 |
| | IGHG2*01 | 257A (CH3 variation) | GCC | 14:106109752 (forward strand) | C | | 0.199 | 0.493 (0.692) | 0.592 |
| | | | | | D | | 0.007 | 0.992 (0.999) | 0.995 |
| | IGHG2*06 | 257S (CH3 variation) | TCC (rs4983499) | 14:106109752 (forward strand) | C | | 0.199 | 0.308 (0.507) | 0.408 |
| | | | | | D | | 0.007 | 0.002 (0.009) | 0.005 |

Table Footnotes:
[10] IMGT notation (ww.imgt.org); refer to figures for other alleles comprising this variation.
[11] Numbering as indicated in Ensembl (available on the World Wide Web at ensembl.org) unless otherwise indicated
[12] SNP Underlined in Codon.
[13] NCBI dbSNP Build 138 released on Apr. 25, 2013.
[14] Human population used for representative variant frequency analysis.
Populations
A This population included 662 participants of European descent from the ClinSeq project, all of whom had undergone whole-exome sequencing using Agilent's 38 Mb or 50 Mb capture kit.
B 1000 Genomes database.
C ESP6500: African_American.
D ESP6500: European_American.
[15] Number of individuals in representative population found to have the allele.
[16] Heterozygous human genotype frequency, ie, cumulative frequency of all genotypes having one occurrence of the variant allele and one occurrence of another allele (heterozygous state), eg, ac genotype in the population.
[17] Homozygous human genotype frequency, ie, cumulative frequency of two occurrences of the variant allele (homozygous state), eg, cc genotype in the population.
[18] Total human genotype frequency, ie, total of heterozygous plus homozygous human genotype frequencies.
[19] Cumulative human allele frequency of all occurrences of the variant allele in the population.

TABLE 17

SEQUENCES

| SEQ ID NO: | Human Allele | Nucleotide/Amino Acid Sequence |
|---|---|---|
| 78 | IL-6R | MLAVGCALLAALLAAPGAALAPRRCPAQEVARGVLTSLPGDSVTLTCPGVEPED NATVHWVLRKPAAGSHPSRWAGMGRRLLLRSVQLHDSGNYSCYRAGRPAGTVHL LVDVPPEEPQLSCFRKSPLSNVVCEWGPRSTPSLTTKAVLLVRKFQNSPAEDFQ EPCQYSQESQKFSCQLAVPEGDSSFYIVSMCVASSVGSKFSKTQTFQGCGILQP DPPANITVTAVARNPRWLSVTWQDPHSWNSSFYRLRFELRYRAERSKTFTTWMV KDLQHHCVIHDAWSGLRHVVQLRAQEEFGQGEWSEWSPEAMGTPWTESRSPPAE NEVSTPMQALTTNKDDDNILFRDSANATSLPVQDSSSVPLPTFLVAGGSLAFGT LLCIAIVLRFKKTWKLRALKEGKTSMHPPYSLGQLVPERPRPTPVLVPLISPPV SPSSLGSDNTSSHNRPDARDPRSPYDISNTDYFFPR<br>D = position 358<br>V = position 385 |
| 79 | | ATGCTGGCCGTCGGCTGCGCGCTGCTGGCTGCCCTGCTGGCCGCGCCGGGAGCG GCGCTGGCCCCAAGGC<br>GCTGCCCTGCGCAGGAGGTGGCGAGAGGCGTGCTGACCAGTCTGCCAGGAGACA GCGTGACTCTGACCTG<br>CCCGGGGGTAGAGCCGGAAGACAATGCCACTGTTCACTGGGTGCTCAGGAAGCC GGCTGCAGGCTCCCAC<br>CCCAGCAGATGGGCTGGCATGGGAAGGAGGCTGCTGCTGAGGTCGGTGCAGCTC CACGACTCTGGAAACT<br>ATTCATGCTACCGGGCCGGCCGCCCAGCTGGGACTGTGCACTTGCTGGTGGATG TTCCCCCCGAGGAGCC |

TABLE 17-continued

| SEQUENCES | | |
|---|---|---|
| SEQ ID NO: | Human Allele | Nucleotide/Amino Acid Sequence |
| | | CCAGCTCTCCTGCTTCCGGAAGAGCCCCCTCAGCAATGTTGTTTGTGAGTGGGG<br>TCCTCGGAGCACCCCA<br>TCCCTGACGACAAAGGCTGTGCTCTTGGTGAGGAAGTTTCAGAACAGTCCGGCC<br>GAAGACTTCCAGGAGC<br>CGTGCCAGTATTCCCAGGAGTCCCAGAAGTTCTCCTGCCAGTTAGCAGTCCCGG<br>AGGGAGACAGCTCTTT<br>CTACATAGTGTCCATGTGCGTCGCCAGTAGTGTCGGGAGCAAGTTCAGCAAAAC<br>TCAAACCTTTCAGGGT<br>TGTGGAATCTTGCAGCCTGATCCGCCTGCCAACATCACAGTCACTGCCGTGGCC<br>AGAAACCCCGCTGGC<br>TCAGTGTCACCTGGCAAGACCCCCACTCCTGGAACTCATCTTTCTACAGACTAC<br>GGTTTGAGCTCAGATA<br>TCGGGCTGAACGGTCAAAGACATTCACAACATGGATGGTCAAGGACCTCCAGCA<br>TCACTGTGTCATCCAC<br>GACGCCTGGAGCGGCCTGAGGCACGTGGTGCAGCTTCGTGCCCAGGAGGAGTTC<br>GGGCAAGGCGAGTGGA<br>GCGAGTGGAGCCCGGAGGCCATGGGCACGCCTTGGACAGAATCCAGGAGTCCTC<br>CAGCTGAGAACGAGGT<br>GTCCACCCCCATGCAGGCACTTACTACTAATAAAGACGATGATAATATTCTCTT<br>CAGAGATTCTGCAAAT<br>GCGACAAGCCTCCCAGTGCAAGATTCTTCTTCAGTACCACTGCCCACATTCCTG<br>GTTGCTGGAGGGAGCC<br>TGGCCTTCGGAACGCTCCTCTGCATTGCCATTGTTCTGAGGTTCAAGAAGACGT<br>GGAAGCTGCGGGCTCT<br>GAAGGAAGGCAAGACAAGCATGCATCCGCCGTACTCTTTGGGGCAGCTGGTCCC<br>GGAGAGGCCTCGACCC<br>ACCCCAGTGCTTGTTCCTCTCATCTCCCCACCGGTGTCCCCAGCAGCCTGGGG<br>TCTGACAATACCTCGA<br>GCCACAACCGACCAGATGCCAGGGACCCACGGAGCCCTTATGACATCAGCAATA<br>CAGACTACTTCTTCCC<br>CAGATAG |

| | HEAVY CHAIN ALLELES | |
|---|---|---|
| 80 | IGHG1*01<br>(CH1 + Hinge +<br>CH2 + CH3 + CH – S) | gcctccaccaagggcccatcggtcttccccctggcaccctcctccaagagcacctctggg<br>ggcacagcggccctgggctgcctggtcaaggactacttccccgaaccggtgacggtgtcg<br>tggaactcaggcgccctgaccagcggcgtgcacaccttcccggctgtcctacagtcctca<br>ggactctactccctcagcagcgtggtgaccgtgccctccagcagcttgggcacccagacc<br>tacatctgcaacgtgaatcacaagcccagcaacaccaaggtggacaagaaagttgagccc<br>aaatcttgtgacaaaactcacacatgcccaccgtgcccagcacctgaactcctgggggga<br>ccgtcagtcttcctcttccccccaaaacccaaggacaccctcatgatctcccggacccct<br>gaggtcacatgcgtggtggtggacgtgagccacgaagaccctgaggtcaagttcaactgg<br>tacgtggacggcgtggaggtgcataatgccaagacaaagccgcgggaggagcagtacaac<br>agcacgtaccgggtggtcagcgtcctcaccgtcctgcaccaggactggctgaatggcaag<br>gagtacaagtgcaaggtctccaacaaagcccttccagcccccatcgagaaaaccatctcc<br>aaagccaaagggcagccccgagaaccacaggtgtacaccctgcccccatcccgggatgag<br>ctgaccaagaaccaggtcagcctgacctgcctggtcaaaggcttctatcccagcgacatc<br>gccgtggagtgggagagcaatgggcagccggagaacaactacaagaccacgcctcccgtg<br>ctggactccgacggctccttcttcctctacagcaagctcaccgtggacaagagcaggtgg<br>cagcaggggaacgtcttctcatgctccgtgatgcatgaggctctgcacaaccactacacg<br>cagaagagcctctccctgtctccgggtaaa |
| 81 | | ASTKGPSVFPLAPSSKSTSGGTAALGCLVKDYFPEPVTVSWNSGALTSGVHTFPAVLQSS<br>GLYSLSSVVTVPSSSLGTQTYICNVNHKPSNTKVDKKVEPKSCDKTHTCPPCPAPELLGG<br>PSVFLFPPKPKDTLMISRTPEVTCVVVDVSHEDPEVKFNWYVDGVEVHNAKTKPREEQYN<br>STYRVVSVLTVLHQDWLNGKEYKCKVSNKALPAPIEKTISKAKGQPREPQVYTLPPSR<ins>DE<br>L</ins>TKNQVSLTCLVKGFYPSDIAVEWESNGQPENNYKTTPPVLDSDGSFFLYSKLTVDKSTW<br>QQGNVFSCSVMHEALHNHYTQKSLSLSPGK<br><ins>D</ins> = position 204<br><ins>L</ins> = position 206 |
| 82 | IGHG2*01<br>(CH1 + Hinge +<br>CH2 + CH3 + CH – S) | gcctccaccaagggcccatcggtcttccccctggcgccctgctccaggagcacctccgag<br>agcacagccgccctgggctgcctggtcaaggactacttccccgaaccggtgacggtgtcg<br>tggaactcaggcgctctgaccagcggcgtgcacaccttcccagctgtcctacagtcctca<br>ggactctactccctcagcagcgtggtgaccgtgccctccagcaacttcggcacccagacc<br>tacacctgcaacgtagatcacaagcccagcaacaccaaggtggacaagacagttgagcgc<br>aaatgttgtgtcgagtgcccaccgtgcccagcaccacctgtggcaggaccgtcagtcttc<br>ctcttccccccaaaacccaaggacaccctcatgatctcccggacccctgaggtcacgtgc<br>gtggtggtggacgtgagccacgaagaccccgaggtccagttcaactggtacgtggacggc<br>gtggaggtgcataatgccaagacaaagccacgggaggagcagttcaacagcacgttcctg<br>tgtgtcagcgtcctcaccgttgtgcaccaggactggctgaacggcaaggagtacaagtgc<br>aaggtctccaacaaaggcctcccagcccccatcgagaaaaccatctccaaaaccaaaggg<br>cagccccgagaaccacaggtgtacaccctgcccccatcccgggaggagatgaccaagaac<br>caggtcagcctgacctgcctggtcaaaggcttctaccccagcgacatcgccgtggagtgg<br>gagagcaatgggcagccggagaacaactacaagaccacacctcccatgctggactccgac |

TABLE 17-continued

SEQUENCES

| SEQ ID NO: | Human Allele | Nucleotide/Amino Acid Sequence |
|---|---|---|
| 83 | | ggctccttcttcctctacagcaagctcaccgtggacaagagcaggtggcagcaggggaac gtcttctcatgctccgtgatgcatgaggctctgcacaaccactacacgcagaagagcctc tccctgtctccgggtaaa<br>ASTKGPSVFPLAPCSRSTSESTAALGCLVKDYFPEPVTVSWNSGALTSGVHTFPAVLQSS GLYSLSSVVTVPSSNFGTQTYTCNVDHKPSNTKVDKTVERKCCVECPPCPAPPVAGPSVF LFPPKPKDTLMTSRTPEVTCVVVDVSHEDPEVQFNWYVDGVEVHNAKTKPREEQFNSTFR VVSVLTVVHQDWLNGKEYKCKVSNKGLPAPIEKTISKTKGQPREPQVYTLPPSREEMTKN QVSLTCLVKGFYPSDIAVEWESNGQPENNYKTTPPMLDSDGSFFLYSKLTVDKSRWQQGN VFSCSVMHEALHNHYTQKSLSLSPGK<br>P = position 72<br>N = position 75<br>F = position 76<br>V = position 161<br>A = position 257 |
| 84 | IGHV3-9*01 | gaagtgcagctggtggagtctggggggaggcttggtacagcctggcaggtccctg agactctcctgtgcagcctctggattcacctttgatgattatgccatgcactgg gtccggcaagctccagggaagggcctggagtgggtctcaggtattagttggaat agtggtagcataggctatgcggactctgtgaagggccgattcaccatctccaga gacaacgccaagaactccctgtatctgcaaatgaacagtctgagagctgaggac acggccttgtattactgtgcaaaagata<br>t = nucleotide number 86<br>c = nucleotide number 272 |
| 85 | | EVQLVESGGGLVQPGRSLRLSCAASGFTFDDYAMHWVRQAPGKGLEWVSGISWN SGSIGYADSVKGRFTISRDNAKNSLYLQMNSLRAEDTALYYCAKD<br>F = position 30 (IMGT nomenclature)<br>T = position 110 (dbSNP nomenclature) |
| 86 | IGHV3-7*01 | gaggtgcagctggtggagtctggggggaggcttggtccagcctggggggtccctg agactc tcctgtgcagcctctggattcacctttagtagctattggatgagctgggtccgc caggct ccagggaaggggctggagtgggtggccaacataaagcaagatggaagtgagaaa tactat gtggactctgtgaagggccgattcaccatctccagagacaacgccaagaactca ctgtat ctgcaaatgaacagcctgagagccgaggacacggctgtgtattactgtgcgaga ga |
| 87 | | EVQLVESGGGLVQPGGSLRLSCAASGFTFSSYWMSWVRQAPGKGLEWVANIKQD GSEKYYVDSVKGRFTISRDNAKNSLYLQMNSLRAEDTAVYYCAR |
| 88 | IGHJ3*02 | T GAT GCT TTT GAT ATC TGG GGC CAA GGG ACA ATG GTC ACC GTC TCT TCA G |
| 89 | | D A F D I W G Q G T M V T V S S |
| 90 | IGHJ6*01 | AT TAC TAC TAC TAC TAC GGT ATG GAC GTC TGG GGG CAA GGG ACC ACG GTC ACC GTC TCC TCA G |
| 91 | | Y Y Y Y Y G M D V W G Q G T T V T V S S |
| LIGHT CHAIN ALLELES | | |
| 92 | IGKC*01 | cgaactgtggctgcaccatctgtcttcatcttcccgccatctgatgagcagttgaaatct ggaactgcctctgttgtgtgcctgctgaataacttctatcccagagaggccaaagtacag tggaaggtggataacgccctccaatcgggtaactcccaggagagtgtcacagagcaggac agcaaggacagcacctacagcctcagcagcaccctgacgctgagcaaagcagactacgag aaacacaaagtctacgcctgcgaagtcacccatcagggcctgagctcgcccgtcacaaag agcttcaacaggggagagtgt |
| 93 | | RTVAAPSVFIFPPSDEQLKSGTASVVCLLNNFYPREAKVQWKVDNALQSGNSQESVTEQD SKDSTYSLSSTLTLSKADYEKHKVYACEVTHQGLSSPVTKSFNRGEC<br>V = position 84<br>C = position 87 |
| 94 | IGLC1*01 | cccaaggccaaccccacggtcactctgttcccgcccctcctctgaggagctccaagccaac aaggccacactagtgtgtctgatcagtgacttctacccgggagctgtgacagtggcttgg aaggcagatggcagccccgtcaaggcgggagtggagaccaccaaacccctccaaacagagc aacaacaagtacgcggccagcagctacctgagcctgacgcccgagcagtggaagtcccac agaagctacagctgccaggtcacgcatgaagggagcaccgtggagaagacagtggccctc acagaatgttca |
| 95 | | PKANPTVTLFPPSSEELQANKATLVCLISDFYPGAVTVAWKADGSPVKAGVETT KPSKQSNNKYAASSYLSLTPEQWKSHRSYSCQVTHEGSTVEKTVAPTECS |

TABLE 17-continued

SEQUENCES

| SEQ ID NO: | Human Allele | Nucleotide/Amino Acid Sequence |
|---|---|---|
| 96 | IGKV1-12*01 | gacatccagatgacccagtctccatcttccgtgtctgcatctgtaggagacagagtcacc atcacttgtcgggcgagtcagggtattagcagctggttagcctggtatcagcagaaacca gggaaagcccctaagctcctgatctatgctgcatccagtttgcaaagtggggtcccatca aggttcagcggcagtggatctgggacagatttcactctcaccatcagcagcctgcagcct gaagattttgcaacttactattgtcaacaggctaacagtttcccctcc |
| 97 | | DIQMTQSPSSVSASVGDRVTITCRASQGISSWLAWYQQKPGKAPKLLIYAASSLQSGVPS RFSGSGSGTDFTLTISSLQPEDFATYYCQQANSFP |
| 98 | IGKV3-11*01 | gaaattgtgttgacacagtctccagccaccctgtctttgtctccaggggaaagagccacc ctctcctgcagggccagtcagagtgttagcagctacttagcctggtaccaacagaaacct ggccaggctcccaggctcctcatctatgatgcatccaacagggccactggcatcccagcc aggttcagtggcagtgggtctgggacagacttcactctcaccatcagcagcctagagcct gaagattttgcagtttattactgtcagcagcgtagcaactggcctcc<br>t = nucleotide number 199<br>c = nucleotide number 284 |
| 99 | | EIVLTQSPATLSLSPGERATLSCRASQSVSSYLAWYQQKPGQAPRLLIYDASNRATGIPA RFSGSGSGTDFTLTISSLEPEDFAVYYCQQRSNWP<br>S = position 87<br>P = position 115 |
| 100 | IGKJ2*01 | tgtacacttttggccaggggaccaagctggagatcaaac |
| 101 | | YTFGQGTKLEIK |
| 102 | IGKJ4*01 | G CTC ACT TTC GGC GGA GGG ACC AAG GTG GAG ATC AAA C |
| 103 | | L  T   F   G   G   G   T   K   V   E   I   K |
| 104 | An IGHG1*01 Heavy Chain | EVQLVESGGG LVQPGRSLRL SCAASRFTFD DYAMHWVRQA PGKGLEWVSG ISWNSGRIGY<br>ADSVKGRFTI SRDNAENSLF LQMNGLRAED TALYYCAKGR DSFDIWGQGT MVTVSSASTK<br>GPSVFPLAPS SKSTSGGTAA LGCLVKDYFP EPVTVSWNSG ALTSGVHTFP AVLQSSGLYS<br>LSSVVTVPSS SLGTQTYICN VNHKPSNTKV DKKVEPKSCD KTHTCPPCPA PELLGGPSVF<br>LFPPKPKDTL MISRTPEVTC VVVDVSHEDP EVKFNWYVDG VEVHNAKTKP REEQYNSTYR<br>VVSVLTVLHQ DWLNGKEYKC KVSNKALPAP IEKTISKAKG QPREPQVTYL PPSRDELTKN<br>QVSLTCLVKG FYPSDIAVEW ESNGQPENNY KTTPPVLDSD GSFFLYSKLT VDKSRWQQGN<br>VFSCSVMHEA LHNHYTQKSL SLSPGK |
| 105 | An IGKC*01 Kappa Light Chain | DIQMTQSPSS VSASVGDRVT ITCRASQGIS SWLAWYQQKP GKAPKLLIYG ASSLESGVPS<br>RFSGSGSGTD FTLTISSLQP EDFASYYCQQ ANSFPYTFGQ GTKLEIKRTV AAPSVFIFPP<br>SDEQLKSGTA SVVCLLNNFY PREAKVQWKV DNALQSGNSQ ESVTEQDSKD STYSLSSTLT<br>LSKADYEKHK VYACEVTHQG LSSPVTKSFN RGEC |
| 106 | An IGHG1*01 Heavy Chain | EVQLVESGGGLVQPGGSLRLSCAASGFTFSPFAMSWVRQAPGKGLEWVAKISPG GSWTYY<br>SDTVTGRFTISRDNAKNSLYLQMNSLRAEDTAVYYCARQLWGYYALDIWGQGTT VTVSSA<br>STKGPSVFPLAPSSKSTSGGTAALGCLVKDYFPEPVTVSWNSGALTSGVHTFPA VLQSSG<br>LYSLSSVVTVPSSSLGTQTYICNVNHKPSNTKVDKKVEPKSCDKTHTCPPCPAP ELLGGP<br>SVFLFPPKPKDTLMISRTPEVTCVVVDVSHEDPEVKFNWYVDGVEVHNAKTKPR EEQYNS<br>TYRVVSVLTVLHQDWLNGKEYKCKVSNKALPAPIEKTISKAKGQPREPQVYTLP PSRDEL<br>TKNQVSLTCLVKGFYPSDIAVEWESNGQPENNYKTTPPVLDSDGSFFLYSKLTV DKSRWQ QGNVFSCSVMHEALHNHYTQKSLSLSPGK |
| 107 | An IGKC*01 Kappa Light Chain | EIVLTQSPATLSLSPGERATLSCSASISVSYMYWYQQKPGQAPRLLIYDMSNLA SGIPAR<br>FSGSGSGTDFTLTISSLEPEDFAVYYCMQWSGYPYTFGGGTKVEIKRTVAAPSV FIFPPS<br>DEQLKSGTASVVCLLNNFYPREAKVQWKVDNALQSGNSQESVTEQDSKDSTYSL SSTLTL SKADYEKHKVYACEVTHQGLSSPVTKSFNRGEC |

TABLE 17-continued

| SEQ ID NO: | Human Allele | Nucleotide/Amino Acid Sequence |
|---|---|---|
| 108 | IGHV3-9*01 CDR1 (IMGT nomenclature) | ggattcacctttgatgattatgcc<br>t = position 11 |
| 109 | | G F T F D D Y A<br>F = position 4 |
| 110 | IGHV3-9*01 FW3 (IMGT nomenclature) | ggc tat gcg gac tct gtg aag ggc cga ttc acc atc tcc aga gac aac gcc aag aac tcc ctg tat ctg caa atg aac agt ctg aga gct gag gac acg gcc ttg tat tac tgt<br>c = position 98 |
| 111 | | G Y A D S V K G R F T I S R D N A K N S L Y L Q M N S L R A E D T A L Y Y C<br>T = position 33 |
| 112 | IGKV3-11*01 CDR3 (IMGT Nomencalture) | CAG CAG CGT AGC AAC TGG CCT CC<br>C = nucleotide 20 |
| 113 | | QQRSNWP<br>P = position 7 |
| 114 | IGKV3-11*01 FW3 (IMGT Nomencalture) | aacagggccactggcatcccagccaggttcagtggcagtgggtctgggacagacttcact ctcaccatcagcagcctagagcctgaagattttgcagttttattactgt<br>T = nucleotide 43 |
| 115 | | NRATGIPARFSGSGSGTDFTLTISSLEPEDFAVYYC<br>S = position 15 |
| 127 | Aflibercept polypeptide sequence | SDTGRPFVEMYSEIPEIIHMTEGRELVIPCRVTSPNITVTLKKFPLDTLIPDGKRIIWDS RKGFIISNATYKEIGLLTCEATVNGHLYKTNYLTHRQTNTI*IDVVLSPSHGIELSVGEKL VLNCTARTELNVGIDFNWEYPSSKHQHKKLVNRDLKTQSGSEMKKFLSTLTIDGVTRSDQ GLYTCAASSGLMTKKNST*FVRVHEKDKTHTCPPCPAPELLGGPSVFLFPPKPKDTLMISR TPEVTCVVVDVSHEDPEVKFNWYVDGVEVHNAKTKPREEQYNSTYRVVSVLTVLHQDWLN GKEYKCKVSNKALPAPIEKTISKAKGQPREPQVYTLPPSRDELTKNQVSLTCLVKGFYPS DIAVEWESNGQPENNYKTTPPVLDSDGSFFLYSKLTVDKSRWQQGNVFSCSVMHEALHNH YTQKSLSLSPG (SEQ ID NO: 127)<br>*DKTHTCPPCP* (SEQ ID NO: 128) = C-terminal part of IGHG1*01 hinge<br>A = start of human IGHG1*01 CH2 sequence<br>K = end of human IGHG1*01 CH2 sequence<br>G = start of human IGHG1*01 CH3 sequence<br>D = Asp 204 (corresponding to position 204 in SEQ ID NO: 42)<br>L = Leu 206 (corresponding to position 206 in SEQ ID NO: 42)<br>Flt1 Ig-like C2-type 2 domain<br>GRELVIPCRVTSPNITVTLKKFPLDTLIPDGKRIIWDSRKGFIISNATYKEIGLLTCEAT VNGH (SEQ ID NO: 129)<br>KDR Ig-like C2-type 3 domain<br>*YDVVLSPSHGIELSVGEKLVLNCTARTELNVGIDFNWEYPSSKHQHKKLVNRDLKTQSGS EMKKFLSTLTIDGVTRSDQGLYTCAASSGLMTKKNST* (SEQ ID NO: 130) |
| 129 | Flt1 Ig-like C2-type 2 domain | GRELVIPCRVTSPNITVTLKKFPLDTLIPDGKRIIWDSRKGFIISNATYKEIGLLTCEAT VNGH |
| 130 | KDR Ig-like C2-type 3 domain | YDVVLSPSHGIELSVGEKLVLNCTARTELNVGIDFNWEYPSSKHQHKKLVNRDLKTQSGS EMKKFLSTLTIDGVTRSDQGLYTCAASSGLMTKKNST |
| 131 | A human VEGFA sequence (isoform 206) | MNFLLSWVHWSLALLLYLHHAKWSQAAPMAEGGGQNHHEVVKFMDVYQRSYCHPIETLVD IFQEYPDEIEYIFKPSCVPLMRCGGCNDEGLECVPTEESNITMQIMRIKPHQGQHIGEM SFLQHNKCECRPKKDRARQEKKSVRGKGKGQKRKRKKSRYKSWSVYVGARCCLMPWSLPG PHPCGPCSERRKHLFVQDPQTCKCSCKNTDSRCKARQLELNERTCRCDKPRR |
| 132 | A human VEGFA sequence (isoform 165) | MNFLLSWVHWSLALLLYLHHAKWSQAAPMAEGGGQNHHEVVKFMDVYQRSYCHPIETLVD IFQEYPDEIEYIFKPSCVPLMRCGGCNDEGLECVPTEESNITMQIMRIKPHQGQHIGEM SFLQHNKCECRPKKDRARQENPCGPCSERRKHLFVQDPQTCKCSCKNTDSRCKARQLELN ERTCRCDKPRR |
| 133 | A human PD-L1 sequence (ENST00000381577) | MRIFAVFIFMTYWHLLNAFTVTVPKDLYVVEYGSNMTIECKFPVEKQLDLAALI VYWEME<br>DKNIIQFVHGEEDLKVQHSSYRQRARLLKDQLSLGNAALQITDVKLQDAGVYRC MISYGG<br>ADYKRITVKVNAPYNKINQRILVVDPVTSEHELTCQAEGYPKAEVIWTSSDHQV LSGKTT |

TABLE 17-continued

SEQUENCES

| SEQ ID NO: | Human Allele | Nucleotide/Amino Acid Sequence |
|---|---|---|
| | | TTNSKREEKLFNVTSTLRINTTTNEIFYCTFRRLDPEENHTAELVIPELPLAHP<br>PNERTH<br>LVILGAILLCLGVALTFIFRLRKGRMMDVKKCGIQDTNSKKQSDTHLEET |
| 134 | A human IL-2 sequence | MYRMQLLSCIALSLALVTNSAPTSSSTKKTQLQLEHLLLDLQMILNGINNYKNPKL<br>TRMLTFKFYMPKKATELKHLQCLEEELKPLEEVLNLAQSKNFHLRPRDLISNINVIV<br>LELKGSETTFMCEYADETATIVEFLNRWITFCQSIISTLT |
| 135 | Nav1.8 AMINO ACID SEQUENCE | MEFPIGSLETNNFRRFTPESLVEIEKQIAAKQGTKKAREKHREQKDQEEKPRPQLDLKAC<br>NQLPKFYGELPAELIGEPLEDLDPFYSTHRTPMVLNKGRTISRFSATRALWLFSPFNLIR<br>RTAIKVSVHSWFSLFITVTILVNCVCMTRTDLPEKIEYVFTVIYTFEALIKILARGFCLN<br>EFTYLRDPWNWLDFSVITLAYVGTAIDLRGISGLRTFRVLRALKTVSVIPGLKVIVGALI<br>HSVKKLADVTILTIFCLSVFALVGLQLFKGNLKNKCVKNDMAVNETTNYSSHRKPDIYIN<br>KRGTSDPLLCGNGSDSGHCPDGYICLKTSDNPDFNYTSFDSFAWAFLSLFRLMTQDSWER<br>LYQQTLRTSGKIYMIFFVLVIFLGSFYLVNLILAVVTMAYEEQNQATTDEIEAKEKKFQE<br>ALEMLRKEQEVLAALGIDTTSLHSHNGSPLTSKNASERRHRIKPRVSEGSTEDNKSPRSD<br>PYNQRRMSFLGLASGKRRASHGSVFHFRSPGRDISLPEGVTDDGVFPGDHESHRGSLLLG<br>GGAGQQGPLPRSPLPQPSNPDSRHGEDEHQPPPTSELAPGAVDVSAFDAGQKKTFLSAEY<br>LDEPFRAQRAMSVVSIITSVLEELEESEQKCPPCLTSLSQKYLIWDCCPMWVKLKTILFG<br>LVTDPFAELTITLCIVVNTIFMAMEHHGMSPTFEAMLQIGNIVFTIFFTAEMVFKIIAFD<br>PYYYFQKKWNIFDCIIVTVSLLELGVAKKGSLSVLRSFRLLRVFKLAKSWPTLNTLIKII<br>GNSVGALGNLTIILAIIVFVFALVGKQLLGENYRNNRKNISAPHEDWPRWHMHDFFHSFL<br>IVFRILCGEWIENMWACMEVGQKSICLILFLTVMVLGNLVVLNLFIALLLNSFSADNLTA<br>PEDDGEVNNLQVALARIQVFGHRTKQALCSFFSRSCPFPQPKAEPELVVKLPLSSSKAEN<br>HIAANTARGSSGGLQAPRGPRDEHSDFIANPTVWVSVPIAEGESDLLDDLEDDGGEDAQSF<br>QQEVIPKGQQEQLQQVERCGDHLTPRSPGTGTSSEDLAPSLGETWKDESVPQVPAEGVDD<br>TSSSEGSTVDCLDPEEILRKIPELADDLEEPDDCFTEGCIRHCPCCKLDTTKSPWDVGWQ<br>VRKTCYRIVEHSWFESFIIFMILLSSGSLAFEDYYLDQKPTVKALLEYTDRVFTFIFVFE<br>MLLKWVAYGFKKYFTNAWCWLDFLIVNISLISLTAKILEYSEVAPIKALRTLRALRPLRA<br>LSRFEGMRVVVDALVGAIPSIMNVLLVCLIFWLIFSIMGVNLFAGKFWRCINYTDGEFSL<br>VPLSIVNNKSDCKIQNSTGSFFWVNVKVNFDNVAMGYLALLQVATFKGWMDIMYAAVDSR<br>EVNMQPKWEDNVYMYLYFVIFIIFGGFFTLNLFVGVIIDNFNQQKKKLGGQDIFMTEEQK<br>KYYNAMKKLGSKKPQKPIPRPLNKFQGFVFDIVTRQAFDITIMVLICLNMITMMVETDDQ<br>SEEKTKILGKINQFFVAVFTGECVMKMFALRQYYFTNGWNVFDFIVVVLSIASLIFSAIL<br>KSLQSYFSPTLFRVIRLARIGRILRLIRAAKGIRTLLFALMMSLPALFNIGLLLFLVMFI<br>YSIFGMSSFPHVRWEAGIDDMFNFQTFANSMLCLFQITTSAGWDGLLSPILNTGPPYCDP<br>NLPNSNGTRGDCGSPAVGIIFFTTYIIISFLIMVNMYIAVILENFNVATEESTEPLSEDD<br>FDMFYETWEKFDPEATQFITFSALSDFADTLSGPLRIPKPNRNILIQMDLPLVPGDKIHC<br>LDILFAFTKNVLGESGELDSLKANMEEKFMATNLSKSSYEPIATTLRWKQEDISATVIQK<br>AYRSYVLHRSMALSNTPCVPRAEEEAASLPDEGFVAFTANENCVLPDKSETASATSFPPS<br>YESVTRGLSDRVNMRTSSSIQNEDEATSMELIAPGP |
| 136 | Nav1.8 NUCLEOTIDE SEQUENCE | AAAAGTGACTGGAAACAGTGAGTAGAAGTAAGTCCTTTATTAAAAGCCAATAGAGAACAG<br>GAGAGAGGAGGGAAGACCTGGATGGCTCTGCATCAAGGGAAAGTTTTTAAAGTTGGAGG<br>AAAGTTAAGCATCTTTAAATGCTGATAGGAAAGAGCTGGCAGACAAGGAGAGAGAAAAA<br>ATGAGGTAGATATGAGATAAGATCCTAAGCAGAGGGAAAGGAATGGTCCTTAGAATGTAG<br>GAAGATACCTCTCATGTTGTAAGAGAAGGGAAGGAGGAAAGAAGGCTGCAGACACAGGTG<br>AGTTGGAGGTTTGATGGTATGAAGTTGGCAGAGTTCTGTTTTTCTCCATGAACTAGGAAA<br>TATGGTCATTGGCTTACTGCAAGGGAAGACAGGGAATAGTGAGAAAAGAGTGTATTTGAA<br>ACCTCAGACTAGAAGAACTGCTGACTAGGGATACCATATGATTCCCAGGCAATACTGAG<br>GTTCCCCATAACCCCTCAGCAGTTCAGGGGAACTGTTCTAGATTGACTTAGCCTTGGGAT<br>TTAGGATAAGGGTGAGGGAGTGGCAAAATTGTGGACCCACAGGTCTAATCTGGTTATGGG<br>AAAAGTGTTCAGCCACAGACTGAACCTGGAGGTCCCAGAGAAATTGGAGGTCCCAATGAA<br>ATTCTCCAATAATCTGGAGTTCTCCAGTAACTTGGAGGTCCAAATGAAATTCAAACAGGT<br>GGGAGAAATGTTGACAATGTCAATAAATAAAAGATTGTGATAAGAAAGTAGCATGAGACTT<br>AAGATAAAGTAGACTATAAACCAAAGTCTTTGATGAATATGGGAGAGTGCCTGGAACTCA<br>GTGGTCCTGGAAATGAGGAGAGAGGGCAGCATGGCTAAATCTGGTGGTGGTGGTAGGATG<br>GTACAAAGTGGTGAAGAAGCAATGACATAGAAGCACATGGGGAGCAAAGACATAACCCTG<br>AGGCACCTGGAGGAGGGTTGAATAAACAGCCTCCCCTGAATGCCTTGCAGGGGAATGGGT<br>TCCTGGGAGGAGCCAAGTGTGAGTTCAGGGAGGGGCCAGATATGAGGGTGGGAGAAGGGC<br>TGTTCTGACAATCAAGATGGGACAGATGAGAGGGACAGGGCCAGTGGGCAAGCTGTCACC<br>TCTCTGTGGTTATGTCCACTCTTATAAGAGTATAAATACTTCCTGAAGAAGAATGAGAAG<br>ATGGAATTCCCCATTGGATCCCTCGAAACTAACAACTTCCGTCGCTTTACTCCGGAGTCA<br>CTGGTGGAGATAGAGAAGCAAATTGCTGCCAAGCAGGGAACAAAGAAAGCCAGAGAGAAG<br>CATAGGGAGCAGAAGGACCAAGAAGAGAAGCCTCGGCCCCAGCTGGACTTGAAAGCCTGC<br>AACCAGCTGCCCAAGTTCTATGGTGAGCTCCCAGCAGAACTGATCGGGGAGCCCCTGGAG<br>GATCTAGATCCGTTCTACAGCACACACCGGGTAAGAGCTACTAGTAGGAATGTCTGCTCT<br>CAGCTCTTGGAGAGGAAGTCTCGGTCCCACCCAGCCCAGAAAGTCCTCCTTGGCCCTGGG<br>TGATGTGGCAGTCTGCTAAAGATTCCGTTAACAACCAAAAAAAATATATATATATATCTC<br>TAACTTATTTGATGATCTCTTTGAATTTTTATGACATTTATGATAGAAACTAACTAAACC<br>CACATCTTCAAAAGCAGATAACTGCTGCAGAGCTTTCAGGGAAAGTTGGCTGTTCCCTTG<br>GATGACCTCTGGCCTGGGGCCTCCAGAGGAGTTGGGTCTCTTTGCAGGTGGAGAGCAGAC<br>ATCTTGAGGTTGGGGGAGGAGCATGGCGGTGAGGACAGAAAGCAGGATGAATTTAAGCCA<br>GTGGTCCTCAACTATGATCTTGGAACCCCTGGTGTCCCCAAAACTGTTTTAGTGGGTTTA |

TABLE 17-continued

SEQUENCES

| SEQ ID NO: | Human Allele | Nucleotide/Amino Acid Sequence |
|---|---|---|
| | | TAAAATGAAAACTATTGTATAACAATACTTGGATGTAATTTGTCTTTTTCACACACTTTC
TCTTATGATCATACATTGGTGAATATAGAGGCTATTGATGGGGGATGATGTCATCACTCT
AAAAGCTACTGGAATGTGTGCCTGTATATTCCCGTGTTTTAAAATTTCCTGAGTTTTGAA
TTTCTAATATGAGATATATATACACACACATATGATGTATATATGTGTGTATACATCTAT
ACACTATATATATACATACAACTATGTATATACATACAACTAGACCATGTAGCTAGTTAT
GTATATATAGGTATATAAGCATATATACATATATATTAATTTCTAATATGATATACATAT
ATCTGGCATAAACAAAAAGGTATCAACATAAACAAAAGTTATTTGGGGTCCTCAATAAGG
TTTGAGAGTAATAATCCCTGAAATCAAAAAGTTTGAGAATCAGTAGTTTAAACAAGAGCT
TCTTCATGACAATTATCTCACCTGTGTTGTATTTTTGATGTTCTACGAGCCAAAAAATGG
TGAATGCATGTTTGGGAGTTAGGAGGACAGGAATCAGCCATCTCAAATATGGCTAGCAGA
GTAAATAAAAAGGCACTGAATATCTTTCTTCCTCCTCTCCCATGCCAAGAGTTCATATCC
TCCTAAATCCTCAGAGGGAGAAACCAGGAGAGGATTTAAGAGACAGAGATGTAGAAGGTG
GAGACAGAAGAAACATTACAAAACAAGGATGGTTCTCTTGTCAGAAGAGAAATTAAATGC
AACCATAACTTCACCATCCTGTTGCCAGAGTCCTCCCCTGGGCATAACACCTCTTACCAG
CCTGAGGATTGGCTGTCTGTCCATTAAAGTACCCTCAGTGGGCTCATCTTGGTGCACTGT
CAGTCCCAGAGATGAGGATCTTGCTGAGAGGGTGAGGATATGGCTTTTAGTCCTTGATCC
TCTCTGCCTCTCTGTACCTGCATTTGACTCTCATTGACCTGTAGTTCCCAGAGCCCTTCT
TGCTCATAAGCCTGAGATAATGCCTCTCATGTTTAAAAACATGGTTGTATAAGGAATCTT
GTTTCTCATTGGAGGTCCACTTTCTGTTTTGTTTTGTTTCAGACATTTATGGTGCTGAAC
AAAGGGAGGACCATTTCCCGGTTTAGTGCCACTCGGGCCCTGTGGCTATTCAGTCCTTTC
AACCTGATCAGAAGAACGGCCATCAAAGTGTCTGTCCACTCATATCCTTTGCACGATTGC
CTCTTCCACGTGTTACAATTAGACCTTGCCTACTGTGTCCAGTACCTTCTTTAGAGGTTA
GCAACAGAGCCCTTATCCAATTGAATCCCAAAAGTACAATGAGGTCATTAGATTGAAAAA
ATGGCTTGGGCCTTTAATGTGTCCCACACCCCAAAGCAGTCCCAAGACACAGAAGAAGTG
TTTATGCAACACACAGGTGGTTTGGATTCACCTCAGACTAATCTAGACACACCTGTGGAT
GCACAACTTGAAAAACATCCTCTTTATGAGGGGAGGTTTGCTGATGCCCCCAGACACATT
CTCACCACGGTGTGTGGTCCGCTTTCCCCACAACACAACAGGCAGTAAGAGGGCCCAAGC
CTTCTTTGGGCAGATGAGATAGGCATGAGTTGTTGCTCTGTGCCATAGCCATGCTGAGAA
GTGGCTGCTTACTGGGCAAAAGAGCAGCACCTCCCAGAGGGCAAGGAAAACAGACCATGA
TGGGAAGAGCACACATAGTCTCAATGGGACCTCATTGGTCATGGGGCACTGTTAACATCA
CAAATTACTCAAAAACTACTAGCAGGTTTAAAATGTCAATAATCTGATGTTCATGCCATA
CAAGACTGTAATGATTAGAGACACATTGGTCAAATGTCTACTATATGAATTGTTTTAGGT
AATGTCAGAAGCTGCTTTCAGGGGATTTTGCAAGGCAAGCCAAACTAGTAGAAAAAAGAT
ACTTTGGTTTGGTTTCCTAAGATCTTCCTGGGTGATCCTAATGGAAAGATCCTAATGACC
TAAGATCCTTGGTCATCGGAAGGATTGGAAGTTCTTTATGACAAATTTAGCCCTGGCTTG
CAGGAGGTTGATGTACAAGAATACACCTGCCTCAGTTGCCTGACAAATGGTAACCAGCCT
TTTCTTAGAAGGCTTCAGTAAAAAAGAGTTCTACCCTGCTCCCTAACTCTGAGGCAGATT
GTTGGATTTCTGGACAGTTGTCATTGAGCTGGTAACCTTGGCACAGTCATCTATCTGCAC
ACTCAACATGAAGCTGCACAGCTTGATGAAGTTGCATTACGTTTTCTCTTTTTACATTTT
TTTCTTTCTGGCTGGCCAGCAAGAATTACGTTTTCTGAGCTGAATCTTGAATTTTCAGAT
TCTACAGAAGGATATTTAATGACAATACAGTCTCTCACTTGCTAAATACTTCCTAAGTGT
CAATACCATCATCAGTTCAAAAGCCTCTGAAGTAGAGATTACCATCCCCATTTTACAGAT
AATGAAACTGACACACAGAGGCATTAAGTAAATTATCCAAGACCATGTAGCTAGTTAAGA
AGTCCAGCCTGCATCCTGCGTAGAGCAGTATCTACAGTGAGGAAGTAGGGTGGAAAGTAA
TCAGGGTAATTATTCTCTCAATGTGTCGTCTCTGCTTGGGTAGTTGTTGCTTTTTCAAAA
TATATACAATTACATGGAAATTACAAATAAAGAGAAATCACAAACATACAAACTCCTCTT
TATGGATTCTGGTTGAATTACATCTGGATAAGTAAGAAACAGCTAATTAGAAATAAAATC
CCCTAAAAAGAACCAAGTGACCAGTGAATATTCTCTTCATCTTGAGATTTGATGAGTAAA
TAATTGCTTGGTAGAGTCACAGCTGGACAGAAAAGCTGTTGAGGGGGTCTCTTCCTCACA
AAAGTCTGCATTTAAATCTCATAAATTTGGTAACTCCAGCCCCAAAAGATACTAGAATTC
TCAGGGCCCTATTATTAATATTTCACCAAAAATATAATTCTAATCACATTTGCTATGAAT
GTTTTCATAACTAATATTATACATAAGATATATTACTTTTAAATATTTGTAGAATTGGAG
ACACGATTTTAGTTTAATCCTTGGATTAACATTTCCCCCCATGTGAGCATATTTCTTAAT
TTAATTGTAAGTCAGCAGGAAAATGTGGTTTAATTAATAGAATTTTCCTTTTCATAATAG
ATGTGTTCCTAAGTAACTGTAAAACTAGACACATCAAGGCATTTACAGAAAACTAAAATA
CATTTAAATACTTCTGCTCAAATTGAAAAATGAGTGTTGTACTCTCTCTGTAGGTCAAGT
TTATCTTCAAGTTTTATTTTTCCTTAGGAAGCACTGTTGGGAGCCCAGCTATTCCTAAGA
AAAATGTCCAAGTGGGAACAATTTACCTTTAGATTCTCCCCACCAACATTTCTTCCCTTC
TATTTTCCCCTTCCACCCACCTTCCTTTCAATGTCTCCCTCCCCTTTTGATAATCCCTTT
GCCCATAGTCTGCTGTCAATATTCTCCACTCTAGCTATTCAGAGTTCTCCACTCCAGCCT
AATCCTACTTGGGGTTTTCTTCCTGAGCCAGTATTTCATTTCCCTGTGCCTGCCTCCACC
GTTCCTACCCAGAAGACCATTTCCTCGGTGGAACTGATCTCAACTAAGTTACCCAAACAA
TCTGATGAAACTAATTCCCATGAAAGTTTGTACCTCTTCACTTATCTCCAAGTTCTAAC
TTTTCTTTGTCTTTTAGAATAAAAAGACATTTGCCAGATGAAATTTCAGGCCATTTTGT
ATACTGAAATGAAGGCTTCGGGGCAGAAGGACATTTTGGAAAAGGGAGTCTGTTTCCTTC
TATCTTGCTCAGAGTTTGTTATCAAACAGATAAGAGTTCACATCTCTGCAGCATGGTTGA
CTAGCTGCATGACCTGAGAAAAGTTATTTAACTTTTATTTTTTGTCAGCCTGTTTCTCAG
CTTCAAAATGTAGATATTTATACCCACCTGTAGATCAGTTGTATTAGAAGTAACATGGAC
AAAGTACTCAGCCTAGCTTAGGCACTCAGTAAATGTTAGTGGTTATTATGTGACAAGATC
ATAAAGCTAATATTGGCTAAGATTTATGAATGTAATCATTCAGCATCAAGGTGATCCTAG
ATGACATCACAGAGACTTGGTGATCTCAGCTTTTCCTTAACACAGGCCTTTCAGGTGGTT
CAGTTTATTTATTACGGTCACTATTTTGGTTAATTGTGTGTGCATGACCCGAACTGACCT
TCCAGAGAAAATTGAGTGAGTAGATTTGCTATCATTATTGTACCATCTCTTTTTGCTTTC
TTTTCTTCCTTCACTTGGCAGTCTTTGTCTTTTATTTATCCTGCCATGCCTCATGTGGGT |

TABLE 17-continued

SEQUENCES

| SEQ ID NO: Human Allele | Nucleotide/Amino Acid Sequence |
|---|---|
| | AATGCTGAATCTCATTGTCTATATGTCTTTGTAATAACCAGGTCTCTCCTTCTGTGAGAT
TTGTTTCATAAACATACATGATTTTCAGTTTCAAAGAGATACAGATTAGTGGTTCTCAAC
TTTGGCTGCATATTGCAATTTTTGGGGAGATTTTTTAAATGCCTGAGTCCCAGCCCCAGA
AAGTCTAAGGTGGCCTGGGAAGATGAGTCTCCTCGCCCCCACCCCCCCCAACACACACA
CACTCACTCACCTGCTAGATGCACACACAAATGTATGCCTTAGAGAAGGTATGCTTTTGA
GAAGGCCTGCTATGAAAGAGAGACAGGAGCAAAACTGAGACAGAACTAAGAACAAATGGC
TCTGGAGTATATTTAGAAAATAACTCATAAATGAAGCTGTTTAAGTTATCATGCTTCATA
TGCCTCAAAGTAACCTTAGTATTCCTGAAGTTATTCTATTTCCCTAGGTTAGTGGGTGAA
ACCCCTATAGTTTCAGAATCTGGGAGTTTTCCAAAAACATTCCATATCCACACATCTGGG
AGGGATGCTTCCACTCCAGCTTGAACCTAACATACCTTTGGTTATAATAACAGGTGCTTT
GCAGAGCTTTCTTTTTTTTTTTTTTTTTTTGCTAATCATAACAGTAATGCATGCCA
CAACAGAAAATACGTTATATTTTTATTAATAGATTAAAGGAAAAGGATCACATAGTCTTC
TTAATTGATGCTAAAATCATTTGATAAAGTTTAATTTCCATTTATAATTTTAAATTCTTA
GAAAAGTTGAAATAGAAGGGAATAAATGTGGCACATATACACCATGGAATGCTATGCAGT
CATAAAAAAGGATGAGTTCATGTCCTTTGCAGGGACATGGATGAAGCTGGAAACCATCAT
TCTCAGCAAACTAACACAAGAACAGAAAACCAAACACCGTATGTTCTCACTCATAAGTGG
GAGTTGAACAATGAGAACACATGGACACAGGGAGGGGAACACACTGGGGCCTGTTGAGGG
GTGGGGGCTAGGGGAGGGATAGCATTAGGAGAAATACCTAATGTAAATGACGGGTTGAA
GGGTGCAGCAAACCACCATGGCACGGGTACACCTATGTAACAAACCGGCACGTTCTGCAC
ATGTACCCCAGAACTTAAAGTATAATAATTTTAAAAAGGGGATTGCATCACTCTGATAAA
GGGTATTCATTGTTTTAAAGTATCAAGCGTCATACTTAATTGTGAACATGGAAAGCTTTC
CCTTTGAGATCAAAAGAAAAAAAAACCAAAGATGTCTGTTCTTCTCAGTTCCACTTTGTA
AAGGAGGTCTCAGCCAGCATAGTAAAGCAAAGAAAAAAAAAGTGCAAGAAGAAAAAAGTA
CCGAAGATGTAATTTACAGATAATAAGATTGTATACATAAAATATCCAACATAACCTAGA
GATAAACAGTAAGAATTAATAAAAGAGTATAGTAAGGTAGCTGGGTACAAATTAACATAC
ATAAATCAATTGTGTATAGACACTAGCAACAAACAGAAAATAGTTTTTAAAAATACCATT
TACACTGGCATTTTAAAATGTCAAGTATCTAGGAATAAGATTATCAAAGTATAAGTGAGA
TCTCTATAAGGAAAATTATAATAAGTATTGTGTAAAGTTTTTAAAGAAAACCAAATCAGT
GGGGAGACATGTTCTCAGATTCAAAGTCTCAATATTGTAAAGACTCCCAAAAATGATTAA
TAAATTTAATATGATCCTCAAATCAATATTTCAACAGGCTTCTTTTGGTATTACTTGACA
AACTTTAAACTTTAAATTTTCTTCCTCAAAAGTTTACATGAAATTTTAAAGAGCAAATTA
TAGCCAAGAAACTTTTGAGGAAGAAATACAAAGTGGGAGAACTCATTCTACTGGATGTCG
AGATTTACTATAAAGCTCTAATTGAAGCAGTGTGCCATTGGTGTAAGATTGGTCAGAATA
ATGTAACAGCATAGACAGTCCATAAACAGACCAACACATATGTAAACATCTAATGTGTGA
AAAGGTGGCACCCCAGAACAGCAGGGAAAAGGCGGTCTTCAAAAAATGATGCTGAAGAAT
TAGGAATCTCACTGGAAAAACTACATTAAACATCCAACTTTGCACCACACACAAGAATCA
ATTCTAGGTGGATCAACACCTCACTTGCTTTGTGAAATGCAAATATATAAAGCCCTTTTT
TAAATTTTACTTTAAGTTCTGGGGTACATGTGCAGAAAGTGCAGGTTTGTTACATAGGTA
TACACATGTCATGGTGGTTTGCTGCACCCATCAACCCATCATCTACATTAGGTATTTCTC
CTAATGCTATCCCTCCCCTAGCCCCCAACCCCTCAACAGGCCCTGGTGTGTGATGTCCCC
CTCCCTGTATCCACGTGCTCTCATTGTTCATCTCCCACCTATGAGTGAGAACATGCGGTG
TTTGGTTTTCTGTTCTTATGTCAGTTTGCTGAGAATGATGGTTTCCAGCTTCATCCATGT
CCCTGCAAAGAACATGAACTCACCCTTTTTTATGGCTGCATAGTATTCCATGGTGTATAT
GTGCCATATTTTCTTTATCCAGTCTATCACTGATGGGCGTTTGGGTTAGTTCCAAGTCTT
TGCTATTGTCAATAGTGCCACAATAAACATACGCATGCTTGTATCTTTATAGTAGAATAA
TTTATAATCCTTTGGGTATATACCCAGTAATGGAATTGCTGGGTCAAATGGTGTTTCTGG
TTCTAGATCCTTGAGGAATCACCACACTGTCTTCCACAATGGTTGAACTAATTTACACTC
CCACCAACAGTGTAAAAGCATTCCTATCTCTCCACATCCTCTCCAGCATCTGTTGTTTCC
TGACTTTTTAATGATCTCCATTCTAACTGGTATGAGACTCCATCTCATTGTGGTTTTGAC
TGGCATTTCTCTAATGACCAGTGATGATGAGCTTTTTATCATATGTTTATTGGCTGCATA
AATGTCTTCTTTTGAGAAGTGTCTGTTCATATCCTTTGCCCACTTTTTGATGGAGTTGTT
TTTTCTTGTAAATTTGTTTAAGTTTTTTGTAGATTCTGGATATTAGCCCTTTGTCAGATT
GATAGATTGCAAAAATTTTCTCCCATTCTGTAGGTTACCTATTCACTCTGATGATAGTTT
CTTTTGCTGTGCAGAAGCTCTTTAGTTTAATTGGATTCCATTTGTCAATTTTGGCTTTTG
TCACCATTGCTTTTGATGTGTTAGTCATAAAGCCTTTGCCCATGCCTATGTCCTGAAGGG
TATTGCCTAGGTTTTCTTCTAGGGTTTTTATGGTTTTAGGTCTTATGTTTAAGTCTTTAA
TCTATCTTGAGTTAATTTTTGTGTAAGGTATAAGGAAGGGATCTAGTTTCAATTTTCTGC
CTAAGGCTAGCCAGTTTTCCCCACACCATTTATTAAATAGGGAATCCTTTCCCCATTGCT
TGCTTTTGTCAAGTTTGTCAAAGATCAGATGGTTGTAGATATGCGGTGTTACTTCTGAGG
CCTCTGTTCTGTTCCATTGGTCTAGATATCTGTTTTGGTACCAGTACCTCGCTGTTTTGG
TTACTGTAGCTTTGTAGTATAGCTTGAAGTCAGGTAGCGTGATGCCTCCAACTTTCTTCT
TTTTGCTTAGAATTGTCTTGACTATGCGGGCTCTTTTTTGTTCCACATGAAATTTAAAGT
AGATTTTTCTAATTCTGTGAAGAAAGTCAGTGGTAGCTTGATGGGGATAACATTGAATCT
ATAAATTACTTTGGGCAGTATGGCCATTTTCACAATATTGATTTTTCCTATCCATGAGCA
TGGAATGTTTTCCATTTATTTGTGTCCTCTCTTATTTCCTTGAGCAGTGATTTTTAGTT
CTCCTTGAAGAGGTCCTTCACATCCCTTGTAAGTTGTATTTCTAGATATTTTATTCTCTT
TGTTGCAATTGTGAATGGGAGTTCACTCATGATTTGGCTCTCGGTTTGTCTGTTATTGGT
GTATGGGAATGCTTGTGATTTTGCACATTGATTTTGTATCCTGAGACTTTGCTGAAGTT
GCTTATCAGCTTAAGGAGATTTGGGCTGAGATGATGGGGTTTTCTAAATATACAGTCAT
GTCATCTGCAAACAGAGACAATTTGACTTCCTCTTTTCCTATTTGAATACCCCTTATTTC
TTTCTCTTGCCTGATCGCCCTGGCCAGAACTTCCAATACTATGTTGAATAAGAGTGGTGA
GATAGGGCATTCTTGTCTTGTGCTGGTTTTCAAAGGGAAATGCTTCCAGTTTTTGCCCATT
CAGTATGATATTGGCTGGGGGCTTGTCATAAATAGTTCTTATTATTTTGAGATACATTCC
ATCAATACCTAGTTTATTGAGAGCTTTTAGCATGAATGGGTGTTGAATTTTGTCGAAGAC |

TABLE 17-continued

SEQUENCES

| SEQ ID NO: Human Allele | Nucleotide/Amino Acid Sequence |
| --- | --- |
| | CTTTTCTGCATCTATTGAGATAATCACGTGGTTTTTGTCATTGGTTCTGTTTGTGTGATG
GATTACGTTTATTGACTTGCGTATGTTGAACCAGCTTTGATCCCAGGTATGAAGCCGACT
TGATCGTGGTGGATAAGCTTTTTGAAAGGAAAAAACAAAGAGGAATATCTTTATGACCTC
AGACTAAGAAAAACTTTATTACATATGACACAAGAAGCACTAACTATACAGGAAAAAACT
GATACATTTTAGTATACTATAATTAAGAATGTTCATCAGAAGACAACTTTAAGAGCATGA
AAAAGCAAGTGCTTATATTCAGAGTAATGAACTCTACAAATCAATTAGAAAAATGTCAGA
ACAACCACTTGTAAAATAGCACAAAATTTGAATAGGCACTTTACAAAAGTGGAAATCCAA
ATGGCCATAAACATATGAAAGTATTCTTAACCTTTTTTTAAATCAAAGAGTTGCAAATTA
AAATCACACTGAGATTTTATTACATGTTCATCATAGAAGGGAAATTTTTTAAAGTGTCAC
AATACCAAGTATTGGGAATGACATGGAGCAACAGAAACTCACACACTGCTGGTGGGAGTG
TAAATTTGGACAACCTCTTTGGAAAGCAAGGGGTATTATCTAGTAAAGGTGTAAGCATAC
ATATGCTGTATTCTTCTATTACACCCTTAGGTACCTATGTTTAACAGAAATATGTACTTG
TGGACACCAGATTACAGCTACAAGAAAGTTTATGAACATTTGCCCATAAAAACCCCAAAC
CGGAAACCACTCAAATGTCCATAAACTTTGAGTACATTAACTATTTCTGTTATATTCTAA
AATGAGAAAACTTACAGCAATAAAAATTAATAAACTTTAGTGCTGCACAACAATAAGGAT
GAGTCTTAAGAAAGTAATATTGAACAAAAAAAGCCAAATGCAAAGGATTACATAAACAAG
GTTCATTTATATAAAGTTTGAAATCAAGCAAAACTAAACTATTTTGTTTAGGAATGCATA
CTTATGAAGTAAAAAGCATCAATAAAGTAAGGCAAGAAAAAGTACCAAAAATTAGGAGAA
TAGTGGCCTCCAGGGCAGAAGAGGGAGGATGTAATTGGGAAGGAGCTGGTGAAGTGCTGG
TCACGTTCCATTTTATGGCATGGGTAGTTGTCACACAAGCTGCTATGGAGTGAATTTTGT
CCCCTCAAAATTCAAATGTTGAAACAAACCCCCCATGTTGCTATGTTGGAGATTGGGCCT
CTAAGGAGGTGATTGGGTTAAATGAAGTCACAAGAGTAGAGCCCTTAAGTGGTAGAACTG
GTGTCCTTATAAGAGAAAGAGACAGCTTTCTCCCCTTTGTGTGAGAACACAAGGACAAGG
TAGACATCTATAAGCTAGAAAGAGAGTCTTTCCCAGACCCAACTATGCTGACATCCCAAT
CTCAGGCTTCAACCTCCAGATTTGTGAGAAAATAAATTTCTGTTGCATAAGCCACCCAGT
CTATGGTATTTGTTAAGGCAACAAAGGCTGACTAATACACAAACATTTGTTTTAAAATA
ATTAATTTATGTTTTATGTACATTTTTATTATGCATGTTACATATCATAATAAAAACCCA
ATAATTTTTTAAAATAAATGACCATTGCAAAAAATGCAGAACACTGAAAATATAAATCAG
AAGATGGTTACTAAGTAGAGAAATCACAAAATCATGAATTATATTTAATATTGTTGAGA
TCATATAGCATGTAAAATGTCTATGCTTCTTTTGGAGTTTTAATGTAAAACATTTTTTTG
CAAAATGAGTTATTTGGGAGTTATTTGGAGATTGTGGTTAAATATGGAAGATAGAATGCA
TATGTTTTACCCCACCCTCTCAAAATGCCAATAGAATGACAGCACGGGGGAAAGAACAGT
ATAAATATACAAGAACAAAGAGAAAGAGAATGGAAAACACAGAGGACAAATGATGTCAAA
ACACTTGGAAGACCAAAAGTGGGTGGAGAAGTGGTAAATCACTTAGCAGATCAGGGTTTG
TTAAACCACGGTGCCTCCAGAGGGGGATAAAAATGAGAATAAAGGCATTTTACCGCCCCC
GCTGCCCAACAAGCCCCAGAGGCCCTGCAAGTGTTGACATGATACAAATAGCAAGAAATG
GAAGCAGAAAGAGGAAAGAACATGTGAGCAGAGTATGTTCACTTACTGCTGCTTCTATAA
TAACAAGAAGTTAAAGAGTATTATTTAAAGTTGACAAATAAAGAAATGGACAAAATAATT
ACACTTGACAGTACAAAGGTAAGCACAAAAAGATATTATTAAATACAGTCAGATAATGGA
TAAAACAGAGAGGAAAGGAATCACCAAATGGAAATGAGAGATTTTGATTAAAGAAATAGT
ACACTAAGGACAATGTATTACACGGTTTTAATTATAATTATAAATTTATAATAAGTTTTT
ACTTATAAAGACAACCACTAGGATAAAGATACAAACTCTTTAGTAATCTATATATTTGTA
ACAAATAATATGACAAACTCTAAATACTGGAAGAATTGTACATCAAAAAATAAAAAGCAA
ATAAGAGATGCCAAATAATGAAAAGGTACAAAAGTAATTGGGGTTTCAGACCATAAATAT
TAAATCATTATAACTAGGCTCAAACACATCTTTATTAATCAAAGTAGGAACCATTACAAT
CAACACATTTTTGCCAATGAGAAATGAGTTTGTTTATTCCTGTAGCATAAAAATCCATGC
TTTGGGATTCAATGAACTCTTGGAAGGCATTTTCTGCATCCCGCTGGTTATGGAAGTGTT
TCACCTGCAAAAAGTTGTTCAGATGCTTGAAGAAGTGGTAGTTGGTTGGTGAGAGGTCAG
GTGAATATGGTGGATGAGGCAAAACTTCATAGCCCAATTCATTCAACTTTTGAAGTAACT
GTTGGTTGTGTGACATGCAGTCGGTTGTTGTGGAGAAGAATTGGGCCCTTTCTGTTGACC
AATGCCAGCTGCAGGCCTTGCAGTTTTCTGTGCATCTCATCGATTTGCTGAACATATTTC
TCAGATGTAATGGCTTTGCTGGGATTCAGAAAGCTGTAGTAGATCAGACCGGCAGCAGAC
CACCAAGCAGTGACCACGACTTTTTTTGGTGCAAGTTGGGTTTTGGGAAGTGCTTTGGAG
CTTCTTCTCAGTCCAGCCACCAAGCTGGTCATTGCCAGTTGTCAAGTAAAATTCACTTTT
TATCGCACATCACAATCTGATTAAGAAATAGTTCATTTTGTTGCATAGAATAAGAGACG
ACAACACTTCAAAATGACGATTTTTAAACATTTTTCCTTAGCTTATGAGGCACCCATTT
ATGGAGCTGTTTCACCTTTCCAATTTGCTTCAACTGCCGAATGACCGTAGAATGGTCAAC
GATGAGTTCTTCCTCAGCTTCTTGTGCAGTTGTAAGAGGATCAACTTCGATGATTGCTCT
CAATTGGTCATTGTCAACTTCCAATGGCCAGCCACTACTCTCCTCATCTTCAAGGTTCTC
ATCTCCTTTGCAAAACTTCTTGAACCACCACTGCACTGTACCTTTGTTAGCAATCCCTGG
GCCAAATGCGTTGTTGATGTTGAGTTGTCTCTGCTGCTTTACAACCCATTTTGAACTCAA
ATAAGAAATCGCTCGAATTTGCTTTTTGTATAACATAATTTCCATAGTCTAAAATAAAT
ATAAAATAAACAGCAAGTAATAAGTCATTAGCAAAAAAAAAGTGAGAAATGCACATTAA
AATGATGTATAACATGGTCACATTTATTTAAGAATGTATTCCAATATCAAACGGCAAATT
TCAACAATGCAAAAACCACAATTACTTTTGTACCAACCTAATATTTTAAAAACTAAATAC
GTCATATGAAATAATATAAACAAGCTAAGACTAAGCAAATCTGTCATGTCACTAAATATA
AATGGATTTTACTCACCTATTTTTAAAAATGCCTATTACATTACAAAGCAATACCCAACT
CTATGTTGAATAAAAAAAATACTCCTCACGGTGATACAGAAAGGCTAAAATTATAGAATT
CAAAAGACATAAGCAAAGGCAAACAAAGAAAGCAGGATCCATGATTTTAATATCAGAGAA
AGTGGAATCTCGGTCAAAAAGCATGAAATAGGACAAAAATTGCACAGACATATTAATATT
AAAGACGATAGTAATCTATATCTTTGCAACAAATAAGATGGCAACAATATTTATAAATCA
GAAATTATTAGAGTAGGAGGATAAATAAAAACATTGTAGGAATAGAAATTTTCAATTAAT
TTTAGCCAATAACAGATCAAATGTATTAAAAGTATGTAAAATTATAGATGACCTAGTAA
TATAATTAATATAATGTATCTGATTAATATATAGCAAACTACCTTCCCTAACAATAGAAA |

TABLE 17-continued

SEQUENCES

| SEQ ID NO: Human Allele | Nucleotide/Amino Acid Sequence |
|---|---|
| | ATGCACCTCCTTTTCAAAAAACCAAACATATCAAACCAAATATTAAGCCATGACAAAAAC<br>CTCAATAAGCTCCAGAAAGTGGAAATAATATAGAAAACATTCTCTGATCATAATGAAATA<br>GAGTTAAAAAAAATAACCAAATTTAATGAAATGAGAGGACTTTCCACTTGATAATTTTTA<br>AAAATCTCTCTTAAAGAATTCTTGGACAAAAGACAAACTATAAACTAAAATTATATAATT<br>TCGAGGGAAGGAAAGATAAAAAACAGTTTAATCAGAACCTAGAGAGTGCAGTTAAAGACA<br>TACATATTCAGGGAATAAGTCACAGCATGGAAGCATAGAATATTTATATCAGTAAAAGCT<br>GAAAAGAAATTATTTAAAGACCTAACAAAACTAGAAAAAGGATAACAAATGAAAGAAAGA<br>AGTTAATAATTATAAAAAGCAATAAATTACAAAATAGAAAAACAGTAGATCTAATAAATC<br>CAAATGCTGTTGTAAAAATATGCACAAGACCTTTATACTAAAAAATAATACAGCATTATT<br>GAGAGAAATTTTAAAGTACCTAAATGAATTAAAGGATGTCTCATGTGACTGGATTAGAAG<br>ATTCATAATTGTTAGAATGTCAGTGCTGCCCAAATTAGTCTATAAATTCAATGACATCCC<br>CAAAAAAATCCCAGCAGCAGCTGTTTTATAGAAATTAGCTGAACAGATTTCATTTGCATG<br>GATGAAGTGAAGTTTATTTAACTATTTTCCTATTGATAGACATTCACATTTATCATAATT<br>AACATAATCCTCATATTTTGCCACCACATATTAATTTTTGGTGAGTATCCTTACACATG<br>TATCTTTGTACACATAATATGAGTAAAATTAAGGATGAATTTCTAGAAGTAGAATTGCCA<br>GGTCAAAGGGGTGTACATTTTAATTTTTGAGATATTGCCAAATCGTCTTCCAAAGTTGGA<br>TCCTTTCCATTCCCAGTAATTATCAAATCCATTCTTTAGGAGATTTTGTATTAACTGAAC<br>TGTTGACATAATTCCCTTTATATGCACACTATGAAAGTATAACATATACAAATCTACCT<br>ATATGGTCACAATCCTGGGAATTTATGTGACAGGTATTGGATGATGTTCAGCATCCTTGG<br>CCTCGTGGAAATAATCAGACTAGATTTTCTTTTTGAAATGCAAATTGATAATAGCCATTA<br>GTTGTTTCCTATGTTGCTGAGAACCCAGAGGAAGATAATAAATGTCCTTGGGATAGACTG<br>GGGCTCCAAAGATCATGCTGTATACTTTTGAAAAAGCATTAAATTGTAGCCAGTGAGGAA<br>TCAGAAACCAATCTTATTGCCATGTTCTTAACACAATCTTTTTCCTTATCTTCCCTCCCT<br>TCCATTATTCCTTGCTGAAACATTAGCTTTGCACAATTACCTGCTGATAATGGTAGCTCT<br>ATGTCTTTCTGCGTGCCTGCCTATCTGTCTGCTTGTGGAAAGATAAAGATAGATATTCCA<br>TTTTCTAATCCCCTCTTTTGCTTGGGAAGAAACTAGAGGTTCTTCCTCAGATTGGGCACC<br>AGAAGGTAAAGAGAGCAGGGGGTCAAAAATTGTTAAGAAGGGCAAGACTAGAACTTTCCT<br>ACTCTCCCCATGCCCTGGTTTCAGAGAATCATTGAAGGGGCTCTTTGATGACCCTAGGAC<br>ACTCACCTCTAAGCATAACAATATTCTGGAAAACCTTTGACAAATTATAGCAATTTGGTT<br>GTAGAGAAGATAAATGTTTTCTCACCTGGCAAAGAACATGTGAAATGAAGCTGAATCTAC<br>TGCAAACGGGGAAGTGGGTGTTTAACACTGCATGCATAAAGTATTGATTTGTATCTTTTC<br>AAATTTATGGAACTGTTATCATTTTATATGTGTGCTTTATCTGATGTTTTAAAATTATGT<br>TTTTGGGATTTGCCCAAATGGATACATGTAGACCTAATTCATTCATTTTTTATTGCCATA<br>TAGTATTCCATAAAGATATTATCCTGTGTTTTCTCCTCAAAGTTACAGTTTTCCTTTCTA<br>CATTTAGGTATTTCAATCTCCTAGAATTTATTTTTGTATGTGTGTGGATGAGATAGGCT<br>TCCAATATTTTTCCATATGGATTATTCCAACATTTTTTTCAATACATCATTTCCCAAGTG<br>GTTCCTACCACTGCTTCTGCCATGCACCAGATTCCCATGTCTACTGAATCTGTTTCTCCC<br>AGTAATCTCATTGTCACATCCTGAGTCAACACCACGTGGATTTAAATGCTCTATAGTAAG<br>ATTTGACCTGGTCGATTCACATGCCCCTCCTTATTTGTCTTCTTGAAAATTATTTTGGTT<br>CTTGTTTCTTTACTTTTCCATATCAGTTTAAGGGTCACATTTTCCAGCTCTTTTCTTACA<br>ACTCTGTGGAAACTTTGTTTGGTAATGCACTGAATTGATTTATCACCACAGGAAGAATCG<br>CCACATTTACAATACGAAGCCTTCCCACACATCAGTATGGCAGATCTCTTAATTTATACA<br>GGTCTTCTTTAATATTTTTCTACATTTTATAATGTCTTTTTCCTAGGTACATTGCAATTT<br>TGGTTGCCCTATTGAATACTTATTATTGCTAAACTGTCTTAATATTATTAATTTCTATAT<br>AGTGATTTTGCATCCAGCAACCCTGCTGAGCTCCTTAAAGTTAAATTTTTCTGTAGATTC<br>CCTTGGACTTCCTATTTAGACAGTTATATTATCTGCAAATAATGACAAACTTGTTTCTTC<br>CTTTATGATTCTTATACCACTTTTTTATTTTTCCTGTCTTATTGAATTGGCCGGGACCTT<br>CAACAAGATGGTAATTCAAAGCTATGACAGTGAGCATATTTATTTTGCTCTTGATTTTAA<br>AGTGTGTGCTTCTAATGTTTCACTATTATGATGTTTATGAGAGTCTCATAATTACTTTTT<br>ATATCAATTTTTTCCATTTCTTGTTTGTTGAGACTTTCATCATGAATGGGTGTTGGCTTC<br>TATCAGTATTTTTATATTTATTGAGGTTATCATATAGTCTTTCATCTGTTAGTATAGTAA<br>ATCTGTAAACTAACAGGTTTGTTAGTCTATTTTTAATGGTTCCAGCTGATCATTTTGCTG<br>GATTCAATTAGGTGTATTTCATTTTATCTATTTTGCTAAATGAGGCTGGCCTGTAATCTT<br>CTTTCATAAACTGTCCCTTTGGGATGTTCCAACTCTCTCCTCAATTGTCCCTGGGAACTC<br>CAACTTATTCTTACTTTGTTTAGCAGAGCAATTCATCTCTCTCCATCTCCTACAATGTTT<br>CTCAACAAGTGATCTAAGGATCTCTATGCACATATAATTTTAAAATCTAACATGTAAGAT<br>TAATTATTATATTCATAGAATTTCTAACTTTTTATGTTTTCAAAAACAGTGTATGTGCTT<br>CAAAAACTGATTTCATTCATAATGGTTAACATGGAGTTAATCATAGGCAGTTTATCTTGA<br>CTAATGTATTTTATTGTCACCTGACAGTTATTTACACTTGTCAGACTTGCATTTGCCATT<br>ATTACTGTCGCTTTGCATAATATCACAATTCAAAAAAAGAGTCATCACTTCGAAAGTGG<br>TTTTCTGAAGCATAACAATAATGATAAAAATAGAAATATAAATCCTACAATGTGAAATAA<br>GGTCACAATGTAAGTAATGAATGGCCTCCATTGTAAAAATACAAAGCATGAATCTGTTTG<br>TCATGAGACAAGTGGATAATGGATGTGGATAATCTCCCAAAACCAGACAAAAATATATAA<br>GAAAATGGGAGCCATGACAATGAATAATGATAATTGAATTTATTGGACCAATGATCCTT<br>TTGTCCTAGTACCCAATTTATTATCTGCTAACGTTTTGTCAAGTAATGATATAAAGCTA<br>TCAAAACTTCCATATTATTTTCCAATAAAGTTTATCAACCCCACTTTTAAACCAATTGAA<br>TATCTCTACTACAAGCACAAAATAAGGCTTTCCCAGTATAAAATTGTGAAAATTTTATGT<br>TAAAGGTTGAGAAGACAACAAAACTATAGAGTCATCATTCATCCTCATATCAAAAATAAG<br>CACAATTGCACTCCTGCTGGTAAGATACAAAACAGTTTCCAAATCAATTACAAATATTG<br>TGGTTGGAGAAGAAACAAGAAAAACAATTGGTATAATTCCTTAATTAGAAGTATTGCATT<br>CCTTATAATGTGACTGGCATTTAAAGTCAATGACTGTTAGGTATACGAGCAGACATTTTA<br>TTTTATAGTTGAACAAAACTATGAATAAGTAAGTTGTCAGCATATCTTCACTATATATAT<br>GGGAAAGACTCAGTGACTTTTTGTTCTATTTATCATGAAGCTAATTTTAAAAGAAGAGCT<br>CTCTGGTTTAATTAAAAATTAGTTTGAACCTATGAAACAGACTTTAAAAGGTATGTTGGC |

TABLE 17-continued

SEQUENCES

| SEQ ID NO: Human Allele | Nucleotide/Amino Acid Sequence |
|---|---|
| | TTATGCACTAATGTTTGTAGCAGCGTTATTCACAATAGCCAAATATGTCCATCAACAGAT
GAATGGATAAAAAATGTAGTATATATGTAAACAATTGAATATCATTCAGTTTTAAAAATG
AATGAGATTCTGATACATGCCACAACATTGACAAAGCATTGTGCTAAGTAAAATAACTCA
AACGCAAAAGAACAAATGTTGCATGATTCCACCTTTAGTAGGTACCTAGAACAGGCAAAT
TCATGGAGACAGAAAGTAGAATGGAAGTTGCCAGAGAGGGGGAATGGGGAGTTATTATTT
AATGGGTACATTTCTGTTCGGGATTATAAAAAAGTTTGGAAACAGATAGTGGTGATAGTT
CCACAATACTGAATGTACTTAATGCCACTAAATTGTGTACTTAAAAATGGTGAAAGTGGT
AAATTTTATGTTATGTATATTATGCATATTTTACCAAAACTTTTTTTTAAAAGAGGAAAG
GTGTTAAATTGCCATTGAAGAAACTCCAGCCACATGGTCAGCAAGGAAAGGTATCACTAT
CCAGATAGAAGATGCTGCTCCCAGATCCCAATGCTAGTGCATACCTTATTCACGGAACGC
AGCTGGGGGTCTGTAATATGCCTCCAGATTCTGATTTGCTGTTGAGGTACACAGTGGAAA
TTGTGAATACAAACTGATTGTGGTCACTTAGTGTACATCTCTTTGGCCTACTGGGCTGAA
ATGAAAAGTGAGTAAGAGAGGCTGCTCTCCCACACTGAATTGCTTTGGCTGGCAAATGGG
AAGGGCTTACACAGAGTTTTAAAAATAAGGAATGAAATGTTTTAAATTACCATTTTTATG
AATACAAGTTGGGTATCTCAGTGATCCATTCAGAATTTGAATATTATGAATCTTTGTTTT
CAGAGCCTGAATATCGGGATTTGTAACAATCAGACATCAGTGGTGCAAGTGGCTCAACGG
CTGAGAACTTGACTTTTTCCCAATACCCAATGATTTTCTTCATTCACCAGAAAAGCACT
TAGGAAATAACACATTGGGCTTATTAAAAATTACATCTGAATGCTGCAACCCAACATCAA
GAAATACCTTGCAGAGCCAAATACCACCAAAGAGAGGATGCAACTCCATTAGCTGCTGTT
GAGCTGGGGCACTTGCCTTCTGGTGAAGCACTGAAAATAGTCTTTAGAGAGCACTCTCTC
CATAATTTCTGGGTCTGTGTTTGATTTGACAAACCAGAAATATCCATCAAAGCTTCCCAA
CAACCTATAATTCTGAGTTAAGATTTTCTAATTTAGAAAACATAAAGAGTGTGGGGGGGA
AACCAACAAGATATGGAAGCTGACAGCTCAAGCAGCTATGCAACCAGATATAGATTCCTA
AATGATTTCAAACACGATTTCTCCTCTCACAGATGTGAAAAAAAATTATTCACTTTTTAA
CTTGACTTTTACTTTTATTTAAGACATATATGTTCATAATTTAAAAGGTCACAGAGTTTT
ATAAAGATTCTGACAAAAAAAACAGCAATTTCATTTTTCTCATCTCTTCTTTCCAGAGGC
CACCACTTTTAGCTTTTTTACCTGTGTCTTCTGATACCTCCCTATCTCCAATAATATAC
TCATAATACTAATTTTTAATTTTTCAATTTCTGATGTTATTTATTGGCTTCCTATTATGA
GAAAAAACTTAAGGCCACATCCACAAACTCATTTCCTCTCACCCTCATCTTCCTGTTACA
GTTATATTGTAATCTTCAGTTAGATCATCAGATAATATATCCATTGTATGACTACATATA
TAATTACATTACATTGCTAAGTAAACACTGTTTACAGCTGTGTCATGCAGTGTACTTTGA
CTATATTTCCTTTTTGCACAATGTTTTGCTTTCCTTGGAGTTAATAAGGATTTTATTTT
TTTGTTTGCTCAGTTTTCTATTTATCCCTAATTTGTTCCCAAACTCTTCTCCAGATGTTT
AATTGTTGCTTCAATTTATTTGCACACATCAGGTGCATGTGTATCATTTTTTTCCTATGG
GAATCACAGCTAGAGTACTTCATCTTCTGCCTCATTCTGACCTAGATGTTTTCTAGGCCT
GATGCACAGCTGTTTTCTAGAGATTTTTTCTTCTTCATTCTTTTTTTGGATTCCTTTTGC
CTCTTCCCTGGATCGCATATATGTTTCTTGTTTGAATGGAGCATATCCTCTAGTAACATT
TTTTTTTAAGACAAAGTCTCTCTATGCTGCCCAGGCTGTTGGCCTCAAACTCCTGGGTTC
AAGTGATCCTCCTGCCTCAACCTCCCAAGTAGTTAGGACTACAGGTACATACCACCATGC
CCAGCTTCTAGTAACTTTATTAGAAGGGTAACTAAGAAGTACATTTCCCAAGACTTCATA
TATTCTACCTTCTTTGACAGTTTGGCTAGGGAAAGACTTCTGTATTAGAAATTATTTCCC
TCTTAATTTTGAAGGCCTTGCTCATTGTCTTCTAATTTCTTTCTAGACCTCCTATTAGTC
AAACAATATACCTCCTAGTCTGATTCTCTAATTTTCAAACTTTTTATCACTTCCTATCCA
TTTCTGCTTTTTTGTTCCACTTCCTGTGAGATTTCCAAAACTTTATTTACAAGTCCGCCT
ATTAGTGTTTTACTTTTGCTATCATATTTTTGTTTTCAAAATTCCATTTTGTCTTTGAAG
GTACTTTTTACATCCTTCTGCTCTTGTTCTATACGTGGAGCCTCTTCTCACCTCTTAACT
CTCTAAAAATATTAGTACAGGTTTTTTTTTTTTGTTTTGTTTTGTTGTTGTTGT
TGCTGTTGTTGTTGTTGTTTTGGAGACGAAGTCTTGCTCTGTCACCCAGACTGGAGTGCA
GTGACGCGATCTAGGCTCACTGCAAGCTCCGCCTCCCGGGTTCACGCCATTCTCCCGCCT
CAGCCTCCGGAGTAGCTGGAACTACAGGTGCCCGCCAAGGCGCCCGGCTAATTTTTTGTA
TTTTTAGTAGAGACGGGGTTTCACCGCGTTAGCCAGGATGGTCTCGATCTCCTGACCTCG
TAATCTGCCCGCCTCGGCCTCCCAAAGTGCTGCGATTACAGGCGTGAGCCACAGCGCCTG
GCCAATACAGTTTTATTTCTCTAACTCTTCTTCTGCCCTCTTTATTGTCTCTTTTTCTTT
TCTTTTCTTTTCTTTTTTTTTTTTTCAGTTGTTTGGTTGCTTTGGTTTCTGGTGTTA
GAAGCATCCTTCAAATTCCTGATGCTCCTTGGCTGGCTGTTCATGTTAAAAGTGCAGCAT
CTTCATGGGCTCTAAACCAGATTATCTTCTGGAAACTTAACGAGGAGCAGAAGTGAATAG
GGAGGGGAGTTGTTTGCCTTTCAGTAGGTAAACTTTTCTTTATATGCATTTTTCAGTATG
CAACTGTTTCCCTCTTCTTCAACTCTTAAGAAAATGAGCATCCAATCCATTTCTGGAGCA
GAAACAGTTTCTCATTGAATGGATGGCATAAAGCAGCATCTAGAAAGCTCAACTGGTTCC
TGTAAAAAACTTTCAAGCAATTCTTTCAGCCCTACTTATCACCCTCCCCCAAACCTTGCT
TTCAGAGATACTTAGCATCTCTAAGTTCCAAGCAGTTCTGGGGCTCTGCAGCATAGCTTG
GCTTGCTTCTGGGTATTCCCTGCTTCAGCCAGTTTTCAGCTTTCTTAGGTCTGCTCTGTC
AGTTACCACTCATCAGTCTGCACTCCAGTTTCTAAAAACTGGGAGTTTTTAGATGAGCCT
CCAGCTTCTTGCAGGATAGGGAGGCCCTGGCAGACATAAACAGGAGAATCCTTGCTCTTC
ACCCGCTACTGCCCTCTGCCTAACCCCAGAACAGCAGAAGCTGCTGGCTGTCCCAGCCAC
ACACATCCCTCCCCACTCCATCTATTTGTGTGGCCCTTCTTTTTCCCTCAGTCTGTGTCT
TGTTTCCTCTCCTTACCTTCTTCCCCCTCATCACCTTGGTGATATTCTTTGCATGTTTTT
TCTTGGAGCAGTCAGAGCAGGTCATCCCTCCCTCCTGGAAGAAGGAACCCCCTGAGTACA
CTCCATGGCACAGTTGACACTCCTTTTCTACCCTCCTTCCCAGATATGTCTTCACTGTCA
TTTACACCTTTGAAGCCTTGATAAAGATACTGGCAAGAGGATTTTGTCTAAATGAGTTCA
CGTACCTGAGAGATCCTTGGAACTGGCTGGATTTTAGCGTCATTACCCTGGCGTGAGTAT
ATCTCTATGCAGATCTGCATGTGTGATAGGAGAGGGGACAAAATGGTGGGTAGGAGACAG
GGCTAACATGCAGGTCCCACTTGGACAGAGTGTGGAGACTCACACCATGAACGTTTGCTC
CAAGAACCACTGCAGGAATATACCAGGAGAACTGAAAGAATTCATAGATCCTTTTAAATA |

TABLE 17-continued

SEQUENCES

| SEQ ID NO: Human Allele | Nucleotide/Amino Acid Sequence |
|---|---|
| | AGTGGCACACTGCTGGAAATTCTGCAAGACAGGTGAAAAACTGTGAGCTCCCAAAGTGTG |
| | AGGGGGGGAAACCTGCCTCCAAACATACATCCCAACTGGGTAATCTGAAAATCCAGATCA |
| | CAGGAGAAGAATTTACCCTTACCTGGAATGTAAATAAATTTAGGAAGCCACACAAAATAT |
| | AAAAGTAGAAACAGCAAAGGGAAGTGCCTTGTAGGCACTCCCAGTCTCCAGCTTGAGACC |
| | AGGGAATCCATCCCTGACTATGTCTCACAGGCACCCTTGGGGAAGGCAGCCAGTGGAATC |
| | AGGGAGGGGTCACAGGATGAAAGAAGTTTCAACTAAAATTAGTAATAATTTCAACTGGGC |
| | ACAAATTTTCTTGAGCAGAATCCAGGGGGCAAATGGGAACTGCAAGCAGACAGTGAGGGA |
| | TGCGGTCCAAAAGTCATGCTTTCTTTCTCAGTGGGGAAGCTCACAGCCTGGGGCAAGGTC |
| | TGAGTAGGGCACTGCAGGAGCAAGACCAGCCTCACCAACTACATGAGAGCTAGGTGAGGC |
| | CTCTCACTAGCAGCTATCCCCCACTTCCCTGGAGAACTCTATGGCACAGCAGAGGCAGCC |
| | AAAATTCCCTCTGGAACACAACCCCACTGGCCTGAGAACCAACCCCCATCCACCACAGTG |
| | GCCACAGCAATCCCTACCCAAGAAGGGTCTGAGTCTAGACTCACCTACCCCTGCCCCCAC |
| | CTGATGGTATTTCCCTACCTGCCTTGGTAGCTGAACACAAAACCCAGAAACTCTCGGAAG |
| | CTTTATGGCCCTGCTCATCACCTAAGAAACTAAAATATTTACCCTGGCCAACTTAGGGTG |
| | AGCTTAGATCCCCCTTCTACTAATGCACTAGTGCTCTCTTGAAAGCATCACCTACCGGCT |
| | GGAGGTCAAACAGCTCAGGCCATTAAAGCAACTCATGACAGAATAACTTTGATCCCAGGA |
| | AAAAGAAAACAACAACCAGTTGCACTGCCTGCAACATCCTGGCTAACCAGACGTCCTGAG |
| | TCTGTCCATATGACAACTTCACTGCTAACATAACTAGCATTCAAGAAAGCCAGCACACTA |
| | AATCTATCTACAGCCTAGGACTCTCACAGACTCTACTTCATTCCTCTGCCACCTTCACCA |
| | GAACAGATGCTGATATCCATGGCTGGGAGACTTCAAGATCAATCACATCACAGGACTCTT |
| | GCAGGCATTTCCCAGTACTACCCCAGAGCCTGGTAGCCCCTCTGTGTGGCTAGGCCCAGA |
| | AGAACAATAACGATCACTGCAGTCCAGCTCTCAGGAAGCCCCATCCCCAGGGGATTGGGG |
| | AGAGCACCACATCAAGAGATCACCCATGAAACAAAAGAATCTGCACAACAGCCATTCAGT |
| | TCCAGATCTTTTCTCTGAAATAGTCTACTCAAATGAGAAGGAACCAGAAAAGCAATTCTG |
| | GTAATATGACAAAAGAGGGTTCAATAACACCCCTCAAAAGATCAAACTAGCTCCCCAACA |
| | ATGGATCCAAACTAAGAAGAAATCTCTGAATTGCCAGATAAAGAATTCAGGGCTGGGCAC |
| | AGTAGCTCACGCCTGTAATCTCAGCACTTTGGGAGGCCAAGGTGGGCAGATCACCTGAGG |
| | TCAGAAGTTCAAGACCAGCCTGAAGCCAACATGGAGAAACCCCGTCTCTACTAAAAAATA |
| | CAAAATTAGCTAGATGTGGTGGTGCATGCCTGTAATCCCAGCTACTCAGGAGACTGAGGC |
| | AGGAGAATTGCTTGAACCTGGGAGGCAGAGGTTGCGGTGAGCTGAGATCGCGCCATTGCA |
| | CTCCAGCCTGGGCAACAAGAGTGAAAATCCATCTCAAAAAAAAAAAAAAAGAATTCAGA |
| | AGGCTGATTATTAAGTGATTCAAGGAGACACCAGAGAAAGATAAAAACCAACTTAAAGAA |
| | ATTTTTAAAACAACAAGATATGGATGGAAAATTCTCCAGAGAAATAGATATAAAGAAAAA |
| | ACAATCACAACTTCTGGAAATGGAAGACTCACTTAGAGAAATACAAAATGCAGTGGAAAG |
| | TTTCAACAATAGACTAGAACAAGTAGAAGAAAGAACTTCAGAGCTCGAAGACAAAGCTTT |
| | TAATAGACCCAAACTAAGACACACAAAAAGAAAGAATTTTTAAAAAAATGACAAATCGGC |
| | CAATAAATTTGGAATCATGTGAAACAACCAAACCTAAGAATAATGGGTGTTCCCAAGGAA |
| | GAATAGAAATCTAAAAGTTTGGAAAACTTATTTGAGGGAATAATTGAGGAAAACTTCCCT |
| | GGCCTTGTTAGAAATATAGATATCCAAATACAAGAAGCTCAAAGAATACCTCTGAAATGT |
| | GTCACAAAAAAGATCATCACCTAGGCAAATAGACATCAGGTTATCTAAAGTCAAGACAAA |
| | GAAAAGAATCTTAAGAGCTGTGAGACAAAAGCCTCAGATAACCTATAAAGGAAAGGTTAT |
| | CTGATTTACATAAGATTAACAGCAGATTTCTCAACTGAAACCTTGCAAGCCAGAAGGGAT |
| | TAGGGTCCCATCTTTAGCCTCCTGAAACAAAATAATTGCCAGCCAAGAATATTGTATGAA |
| | GAGAAACTAAGCTTCATAAGTGAAGACAAGATAAAGTTTTTTTCAGACAAACAAATGGTG |
| | AGAGAATTTTCCACTACCAAGCCAGCACTACAAGAAATGCTAAAAGGAATTCTAAATCTT |
| | GAAATAAAACCTTAAAATACACCAAAATAGAACCTCCTTAAAGCATAAATATCAAAGGAC |
| | CTATAAAACAATAACACAATAAAAAAGGAATTAAGGCAATAACTAGCATAATGAATAGA |
| | AGAGTACCTCACATCTCAATACTGATGTTGAGTGTAAATGCCCTAAATGATCCACTTAAA |
| | ATATACAGAAGGGCAGAAAGGAAAAAAAAAATCCACCAACCAAGTATCTACTGTCTTCAA |
| | GAGACTCACCTAACACATAAGGAGCCACATAAACTTAAGGTAAAGAGATGGGAAAGATA |
| | TTCCATGCAAATGGAAACCAAAAGCAAGCAGGAGTAGCTATTCTTATATCAGAGAAAACA |
| | GACCTTAAAGCAACAACAGTTAAAAAAAGACAAAGAGGGACATATATAATGATAAAATAA |
| | TTGGTCTAATGGAAAAATATCATAATCCTAAATACATATGCACCTAACACTGGAGCTCCC |
| | AAATTTATAAAACAATTACTACTAGACCTAAGAAATGAAATAGACAGCAATATAATAATA |
| | GTGGGGGATCAATATTCCACTGACAGCACTAGACAGGTCATCAAGACAGAAAGTCAACAA |
| | AGAAACAATGAACTTAAACTGTAACCTAGAACAAATGGACTTAACAGATATTTAAAAAAC |
| | ATTCTACCAAACAACTGCAGAATATACATTCTTTTCATCAGCACATGGAATATTCTCTAA |
| | GATAGACCACGTGATAGATAACATAACAAATCTCAATAAATTTAAGAAAATAGAAATTAT |
| | GTCAGGTATCCTCTCAGAGCACAGTCGAATAAACCTCGGAGTTAACTCCAAAAGAAACCC |
| | TCAAAACTATACAAATACATGAAAACTAAACAATCTGCTCTTGAATGATCTTTGGGTCAA |
| | CAATGAAATCAAGATGGAAGTTTAAAAATTTTTTGAACTGAATGATAATAGTCACACAAC |
| | TTATCAAAACCTCTGGGATACAGCTAAAGCAGTGCTAAGAGGAAAGCTCATAGCATTAAA |
| | TACCTACATCAAAAGTATGAAGAGGACAAATAGATAATCTAAGGTCACACCTCAAGGA |
| | ATTAGAGAAACAAGAACAAAACAGACCCAAACCAAGCAGAAGAAAAGGAATAACAAAGAT |
| | CAGGGCAGTACTAAATGAAATTCAAATAAAAATAATAATAATACAAAAGATAAGTGAAAC |
| | AAAAAGCGGGTTCTTTAAAAAGATATAGAAAATTGATTGACCATTGGCAAGATTAACCAA |
| | GAAAAGAAGAGAGAAGATCCAAATAAGCTCAATTAGAAATAAAATGGGAGATATTACAAC |
| | TGATACCACAGAAATACAAAAAAAAAAATCATTCAAGGCTACTATGAACACCTTTATTTGC |
| | ACAAACTAGAAAATTTAGAGGAGATGAATAAATTCCTGGAAATATACAACTGTCTTAGAT |
| | TAAATCAGAAAGTAATAGAAACTCTAAACAGACCAATAACAAGTAGCGAGATTGAAACAG |
| | TAATTCAAAAATTGCCAAGGAAAAAAAGTCCAGGAGCAGACTGGATTCACAGCTGAATTC |
| | TATCAGACATTCAAAGAAGAATTGGTACCAATTTTATTGAAACTATTCCAAAAGATGCAG |
| | AAAGAGGGAATCCTCCTAAATCATTTTATGAAGCCAGTATCACCCTAATACCAAAACCAG |
| | AAAAGGACTTTTAAAAAAGAACTACAGACAATATCCCTGATGAACATAGATGCAAAAATC |

TABLE 17-continued

SEQUENCES

| SEQ ID NO: | Human Allele | Nucleotide/Amino Acid Sequence |
|---|---|---|
| | | CTCAACAAAATGCTAGCTAATTGAATCCAACACATATCCAAAAGATAACACACCATGATC
AAGGGGGTTTCATACCAGGGAGGTAGGGATGATTTAACATACACAAGTCAATAAATGCTG
CACGTCACATAAACAGAATTAAAAACAAAAATCATATGATCATCTCAATAGGTGCAGGAA
AAGCATTTGACAAAATCCAGCATCCCATTATGATTAAAACCCTCAACCAAATTGGCATAG
AAGGGACATACTCCAAGGTAATAAAAGCCATCTATGACAAATCCACAGCCAACATTATAC
CAAACAGGGAAAAGTTGAAAGCATTCCCCCTGAGAACTGAAACAAGACAAGGATGCCCAC
TTTCACCATTTCTATCCAACATAGTACTGGAAGTCCTAGCCAGAGCAATCAGACAAGAGA
AATAAATAAAGGGAATCCAAATCAGTAAAGGGGAAGTCAAACTGTTGCTGTTCACCAATG
ATATGATCGTATGCCTAGGAAACCCTAAAGACTCATCCAAAAAGCTCCTAGATCTAATAA
ATGAATTCAGTAAAGTTTCAGGATACAAAACAATGTATACAAATCAGCAGCACTACTGT
ACACCACCAGAAACCAAGCTGAGGAACAAATCAAGAACTCAATCCCTTTTACAACAGCTG
CAAAAAAAAACAAAAATAAAAACAAAAAAATCTTAGGAATATACCTAACCAAAAAGGTG
AAAGATTTCTACAAGGAAAACTACAAAACACTGCTAAAATAAATCACAGATGACACAAAC
AAATGGGAACACATCCCATGCTCATGGATGGATAAAATCAATATTGTGAAAATGACCTTA
CTGCCAAAAGCAATATACAGATTCAATACAATTTCCATTGAAGTACCACATCATTCTTCA
CAGAAATAGAAATAACAACCCTAAAATTCATAGGGAACCAAAAAGGAATCCACATAGCCA
AAGCAAGACTAAGCAAGAATAACAAATCTGGAGGCATCACCTTAGCTGATTTCAAACTAT
ACTACAAGGCTATAGTATAGCCTGTACCAAAACAGCATGATACTGGTATAAAAATAAGCA
CATAGACCAATGGAAAAGAATAGAGAACTCAGAAATAAAGCCAAATACTTACAAGCAACT
GATCTTTGAAAAAGCAAACAAAAACGTAAGTGGGGAAAGGACACCCTATTCAACAAATGG
TGCTGGGATAATTAGCAAGCCACATGTGGAAGAAAGAAACTGAATCTTCATCTCTCACCT
TATACAAAAATCAATTCAAGATGGATAAAAGGCTTAAATCTAAGACCTGAAATTATAAAA
AATTCTAGAAGATAACATTGGAAAAACTCTTCTAGACATTGGCTTAGGCAAAACGTTCCT
GACCAAGGACCCAAAGCAAATCCAACAAAAACAAAAATAAATAGATGGGATCTAATTAAA
CTAAAAAGCTGTTGCACAGCAAGAGAAATAATCATCCAAGTAAACAGACAACCCATAGGA
TGAGAGAAAAATCTTTGTTATCTATGCTTCCAGCAAAAGACTAATATCCAGCATCTATAA
GAAACACAAATAAATCAGCAAGAAAAACAAACAAATAATCCCATCCAAAAGTGGGCAAGG
ACAAGAATACGCAATTCTCAAAAGAAGATATATAAATGGCCAATGAACAGGAAAAAAAAA
TGCTCAACATCATTAATTATCAGGGAAATGCAAATTAAAACCACAATGAGATACCACCTT
ACTCCTGCAAGAATGGCCATAACCAAAAATAATAGATGTTGGCATGGATGTAATGAAAA
GGAAACAATTTTACACTGCTGGTGGGAATGTAAACTAGTACAACCACTAAGGAAAACGTT
ATGGAGATTCCTTAAAGAACTAAAAGTAGAACTACCATTTGGTCCAGCAATCCCACTACT
GGGTATCTACCCAGAGGAAAATAAGCCATTATTAAAAAGACACTTGCATATGCATGCTTA
TAGCAGCACAGTTTACAACTGCAAAAATATGGAACCAGCCTAAATGCCCATCAACCAACA
AGTGCATAAAGAAAATATGGTGTATGCATACCATGGAATACTACTCAGTTGTAAAAAGGA
ATGAAATAATGGCATTGGCAGCAAGCTGGATGGAGTTGGAGACTATTATTCTAAATGAAG
TAACTCAGGAATAGAAAGTCAAGCATCATGTGTTCTTAATTACAAGCAGGAGCTAAGCTG
TGAGGATGCAAAGGCATAACAATGACATAATGGACTTTGGGGACTTGGGAGGAAAGGTGA
GACGAAGGTAAGGGATAAGAGACTACACACTGGGTACAGTGTACACTGCTCGGGTGATGG
TGCACCAAAATCTCAGAAATCAGCGTTAAAGAATTTTTCTGTGCAACCCAACACCACCTG
TTTCCCAAAACTATTGAAATACAAATAAAGAACTTATTCATGTAACCAAAAACCACCTGT
TCCCTCAAAACTATTGAAATAAAATAAAATAAAAAGATTTGCATGGGTGTCCATGTGGGG
CTTATGGGTGTATCCAGGCTCACACTCTGAAGAAGGTTCTTCATCTCAGTTCAGCTTCCT
CATTTGGAATTGTATGGCCTGGGGTTCTTGCCACAGAGTACCGCTTCGGGGGTTGCTTTC
CAAGATTAGTCCCATGCCCATGAGGAGATGTCAGAGACCTCAAATCTGAGATAACAGTTA
GCCTGTCACAGTGGATCAGAAAAGGCCCAGCCTTGTACCCCCTGACATGGCGGTCTCCT
TCTGAGAAATCAGTGTCTGAGGAGACTGGTTGGTCAAACTCCTGTGTTTGAAGATCCGTC
CACATGCAGTGTTGCCTAGATCACAATGCATCTTCTCAAAGGGTCCACTCTGAAAGATGT
TGCAATAATGAAATCAGTGTCAGTGTCAGTCTATAGATGGCAGTGTCACTAGATTCTAAG
TGTCCATTCTGCATCCTTTCTAGGCTAATGATACCCCAGGTTATCCTTATTTATGCTGCA
TGCATCCCCAGGACCCTGCTTGCAGAGATGCTGACTAACTTCTGGTCCTACAGATATGT
TGGCACAGCAATAGATCTCCGTGGGATCTCAGGCCTGCGGACATTCAGAGTTCTTAGAGC
ATTAAAAACAGTTTCTGTGATCCCAGGTGAGCATTTATTCACAGAGCATATGTTGGTTTT
CACAGCCTAACTCCCTTCTCTAATTTTCACAAGAACCCTGTAAGGTTCCAGGGCAAAGAC
TATTGTCCCCACTTACAAGACAAAGGAACTGAGGCCTGGAGTATAGGAAACATAAACCCA
AGGCCTCTTCACTAGTAAGAGACAGTGTGACCTGGAAGCCTATTGTCCCAACTCCTAGGC
CAGTGCTCTTCCCACATACCACATGGCCTCACAATCAATACGTAACAGGAGGGGCATGTC
TTCACTTTCTGTTCTGGTTGTGGGATTCAGGCAAGACCCCTCAGTTGAATTTTTATTTAT
ACCTTAAACTAAAGGATTAAACTTGGAAATGGGGAGGAAGGGAGAAAGCAGTCCCAGTAT
CTTCACTGTTTCCGTAGGTCTAAAATCCTGTCTTTAGACACCCAGAGGAAAAAGAATTA
GGCAATTCTTGATTACTGAGAATTCAGAAACAAAAGTAGTCCATCAAAGCTCATTGTGTG
GGGCCTCTAAGATCTCCACTGTCACCAGTAGCCCAGCGACTACTCTTCAGCCCCCATGAG
GTTGATGGTGAGGATGGGGAGGCCAGAGACAAGGCAAACTTTCTGAAATGGGACTTGATG
CTTCCCCTCTGTGGCCTGATAGGTTCTCTCCTCTCACCCCAAGAATTCGTTCTCTTATCT
GTAAACAGAAACACCCATTCTAGAGTGGAAGTCTTTTCTACCATTTCTTGTCTGGCTCTG
CAGGGAAAGATAGGAAACTCTCTGCCAATTCCCACTGGACACACCTCTTGAAGAGAGCCC
TGGTCCTGCCCCTTCATATCTCTCACTTACTCTCAACTGGGAAGACCCTGAGTCTTAT
TTGCAAGACCTGGTCTGTCCATACTGTCTCTTCTGCCTCATCTCTCACCTCTCCTCACAT
CTCACCATGCTCTGGAATCCACCTACGGTTCTGCAAATACTCCACACCATTGCTCACCTC
CCAGCCTTCTACTGTGCTGCCCCTTCTTCTGGGATATCCTTCCTCCTCTCTTTACTCAAC
TCACACTCATTCCTCAGGGCTCTGCCAAGGTTTTACCTCCTCCCTGGTTTTCCCACCTTC
CTCACACTCCACCCACCCCATTCCCACCTCTGGAACTTCAGTTAAGGGCTGCTCCCCTGT
GTGCCCATCTGCTCAGTAATGCTACAGACTTTCCCCTCAATTGTCAGACAACGGCACTCG
ACATGCTGCTGCCTTAGCCATCACTCAGCTCCCAGTCCAGGGACTGACACATGTAGTGCT |

TABLE 17-continued

SEQUENCES

| SEQ ID NO: | Human Allele | Nucleotide/Amino Acid Sequence |
|---|---|---|
| | | CAGTGGATTATTTGCTGACCAAAATGACTAACCAAAAATAAATCCTAGATTGCTTCCCTG<br>GTCAGAGCTCTTTCTGCTACCTGCGAAGCTGCTCTCCCAAAGAAGTTGATTTTACTTACC<br>AGAGCAACAAATCATCCCTCCTTAAACAAGCAGGTGTATCCTTCTTTGCTGCCAGCTGTG<br>CTTGGCACAAGTTCTATTTATGCCCCAGTGACTGTCTCAGTGTTTCTTATAGTCTCTTTC<br>TATTGCTAAACTCACCTCTCTGTTTCTCTGTGTCTCTTTCTTTTTCTTTCTCTTGGTCTA<br>TTTTTGTTTCACTCTATCTCTCTTGCATCTCTCTCTCTCTCTTTTCTCTCTCTCTCT<br>CTCTCTCTCTCTCACACACACACACACACACACACTCACACACAGTGAGGTTCATGTGTC<br>CCAAGTCTCAAGCTGCCTCCCAGATGCATGCAGAAAGACAGATGCCAAATTACTGGGGTG<br>AAGTTAGTAGCTTCATGCCTAGCACAGTGCCTGGAAAAGTAGGTACTCAGCATAAATTA<br>TTTAAATTGAATTGCTAGTGTCAGGAATTTTATTAGCCTCAAGATGATAAAAAATGCATT<br>GCCTGGGTCTCAGTTGCATCGTCTTTATAATGAGAATAGCCCCTGACTCTCTGCCTGCCT<br>CTCAGAGTAAATGCAAGCTTCGGATGAGAAAGGTCTTGGAACTGCCCTGGAGTGTGTACA<br>TACTTCACTCCTGTATGTAGAGATGAAGGAGGATGGCTAAGATGAAGAAGTGTGCTCCGT<br>GTGTGCTACCTCATCCATGTGGTCATACCACTGTCATCTTCCCGCAGGCCTGAAGGTCAT<br>TGTGGGGGCCCTGATTCACTCAGTGAAGAAACTGGCTGATGTGACCATCCTCACCATCTT<br>CTGCCTAAGTGTTTTTGCCTTGGTGGGGCTGCAACTCTTCAAGGGCAACCTCAAAAATAA<br>ATGTGTCAAGAATGACATGGCTGTCAATGAGACAACCAACTACTCATCTCACAGAAAACG<br>TGAGTGGAGTCTCTTCCATAGGGACCAAGGTCTGGTTGGACCCTTGGTATCATATAGGGA<br>CAGGGGATATGGAGCCCCTGTGTGTGTGTATAGACATATATTTTGACTCCCCTTTCCTGC<br>CAAAATGGTTCTCTTGAGTTGTGTTTTACTTTTGGGTATTCTATTTCCTGTTGCTCAGCA<br>TCCCTCTTGCAAGGAAATGAGCCATAAATCTAGAGGCAAGTCATTCTACCTCTGCTGGGG<br>GAGATTGAGAGCCGAAGTCACTGCTTAGCTCTTCTCTTTTCAGATGTGACTTTACAACTT<br>CCATGTGGCCCAGCATGCCCACTGAGTACATGTAGCCAAAGGAGCTCACTTTGGAAGACT<br>TGGGAATATTGCATTCACCACACAAGGCTTGGGTTGGAGGGTTCAGAACCATCTGTGAGG<br>CTTTCTTTTCTTCCTTTCTTCAGCAGATATCTACATAAATAAGCGAGGCACTTCTGACCC<br>CTTACTGTGTGGCAATGGATCTGACTCAGGGTGAGTTCCCAACTTATGACAAAGCACGAG<br>TGCCCAACAATTCCTTCTCCATCTTGTCCTTGGCATATTATGGGCACAGATGGGGTTGCA<br>GGTCCTGGGAAAGATGTATAAATAAATAAATCATGGCCTTTGCCAACCCAGAGCTCATGG<br>GGAGGGAATGTATGAGTTAGCTTTCGCTGTGTAACAAATGACCCCAAAATTTTGTGAATT<br>AAAACAACAATGTATTTAATTCATGATTCTGTGCATCAGCATTTTGGACTGGGATCAGAT<br>GGGCATTGGGTGACATTGACTAGGCTCATTCATGCATATGCAGACAGCATATTAACTTGG<br>AGATGGCTGGTCTAGGACGTCCTGTCTCTGCTCATGTGGCCTCTCACCCCCAAACAGGTT<br>AGCCTGGGCCTGTTCTCATGGCAGTGTTCCCAGAAAAACAGTGGAAGTTTGCAAGGCTTC<br>TTCAGGCCTAGGCTTAGAACCAACACAATGTACCTTTTGTACATTCTGATACATTCTTGA<br>CTAAAGCAAGTTGCAGTCCAGTAGAGATCCAAGAGACAGAGAAATAGACTTCATCACTCA<br>ATGGAAAGAGCTGAAAAGTCACATTGGAAAGGGTGTGGATACATAGAGACAAGAATTATA<br>GCCATTTTAATAAATAATCTACCCCAGGAAGGAACCAATACTTATTTGTGTCAAATGCTC<br>TACACTTAATCATCACAGCTAACTCCATTCTATAGCCACATTACCCTCACAAGTAGAGGA<br>AAAAACACATGTATCAGACTTTGCAATTTCGAATTCTTACAGAGGCCAGATTCATAACAA<br>CAAATGAGTGGAGTGGGCCAGGAGGGAACCTAGGAGCTGAGAGTTCATGCCTCCTCTAAA<br>GGGGACAGCCCCACTGCTCGGTCCAGCTTTTGGTTGCCATGTGGAAATGTGGGTTCACTG<br>TTTCCAGCTCTTCCAACTTTTAAAATAGAGATAGGAAATTTAGATTTTTATATAAAATCT<br>CCCAACCGTAAACATTGGCTACCTATTCCAAAAAATGTCTACATATTGTTGGGCAAACA<br>AAATATTTCTGTGGGCCAAATCCAGCCTATAAGCTGCTAGTTTGCAATTTCTCATTCATA<br>GACATAAAGATGCTACCCTGTGGAAAACAAGTTCTTTACTAGAGGCTTCATAGGCTGGGC<br>AAACACAGTGAGGTGGCGGTGTGAGGCAAGAGAGAAAGTAGGGAAGGCTTCCTGGAGGTG<br>GTGTTTGAGGTGAGCTTTCAAGGGCAGGTAGGATGTCTCCAGGCTGGGTGAATACGAGAT<br>AGTTTCAGCGAAGACCATTCCAGGTGGCAGAACAGAATGTGAGACAAAGCTAAGGGATGA<br>GGACCCCTCAGCTCTGCCTGCTGCTTTGGCCACTGGAGGAAGGCATGAGCAGAAAGACTT<br>TAGGCAAAAGATCAAAAAGGCCCATCTCACCCACCTCCATGGCTGAGAGCTTGGAAAAGC<br>AGAGCTCACAACACCCCAGTGCCTGAGAGGCTGACGGCTCCATGTTGCCCAGGTCGACC<br>TGTGTGGAGCCTGCATGAGGCTCCACCTTCATCAGCTCACTAGGAAAACTATCTCAGTTG<br>GAGCTGAGGACTGGAAACAAGCAGGAGCATTTGGTCAACATCAGGTTCCTTGGACTGTTC<br>TTTCACAAATGCACTTGGCATTTGGTTCTTTGGCTCATGAGAGGGTTGTTCTGACATCAG<br>TTTTCATTTGCCTTTGACTTAAATGTAAACCAAGAGCCCCTCAGCATCCTTCTGTCTAGA<br>TAATGGCATTTCTCAAGGCAATGGCTCCAGAGCAGCTCAAGTCCTTTTTGTGGTAAAGTT<br>GTTGGGTCCATCTACACACCTCTACAGCTCAGCTCCCTGAGAGGGCCAGGCCTGCTATTGG<br>GCAGGTGCCAGCCAGGCAGTGGGGGAGTGGACCAGGCTGGGATGGCAGAGAGAGGCCAGC<br>TCAGGATAACGGACAGAGTGAACCCTGCCGGGGCATGCCGTGAAAGCTAAACCTGGGTCC<br>TCTGTGGGGCTGCAGAGAAGCCAGAGTCCTGAGGAAAGGCCCACATTGGCCAATGGCACT<br>GTGGGAGGAAGGTCAGGGGTCTCAAGGCAGAAAATGGATACCAGAAAATAGTTGATAATT<br>TTCAGTGTTCTTCCACATATATTATTCCAGTTTATCCTTTCAGCAGCTTCCAAGGTTAAA<br>AACAATAGGAATTTTCCTTTGCAGTTTATATACAATATTTACTATGCAGAAGTGCAAGAC<br>ACTATACAGTGATCTCATTTAATCCTCAGAGCAGTGAACTGTTTATATGCAGTGGCTATG<br>GTGGATTTCTACAGAAGACATAGAAACAAGGCTGCCCTCAGAGTTAATTAAGAAACCTAC<br>AGGAAATGGGTTGCCTAGCCCCTTGGAAGAGCAAACCAAGAGCCTATCTTTAAATGTGGG<br>TCTACAAAGCCAGGGAACTTGCAATCTTCAATCGAAGTGGAGATAGACTTGGAACTGATT<br>AGAATTAAGTTGTCAGAGCTCTAATCCATGGTATGGGTTGTTCACATGGATGTCTGGGAT<br>AAGGAGAGCCCCAGAGGTTGGAGTTCATGGAGAAATCCTGGGAGTAAAAGAATTCCATGT<br>ATTCACAAGGAATGCAGGTAAATAAAACAGGAGAAAAAGAAAAAAATTTAAAAAAATAAT<br>TCTGGACTTCAAACGAGGCATTGCTGTTTCATTGATCAGGCCATCTCTGCTAGGGTGGAT<br>GAGAGCACTTTACGCTCCCTGAGCTGACAGATGCTTCTTGACATCGACTCATCCTCCTAT<br>TATGAGAGAGAGGAAGGAGTTCAGCATTCCCACCTCAATACTCACCAGGCAGTCATTTTT<br>AATCTGGCCTTCCTTCATAGGCCATCTTCAGGAGGAGGCTAGGCTGACTCAAGTATTGGG |

TABLE 17-continued

SEQUENCES

| SEQ ID NO: Human Allele | Nucleotide/Amino Acid Sequence |
|---|---|
| | CTACTTGACAGTTATATTTCTCCTTTTAATAAATATATTGACACCTGCGTAGTTTTAGGC
AACTGACTTCTTTCTGACCCCCAGATTCCTTATCTGTAAAGAAAGAACATTGAGTGATTA
AATTATAGTGTTTGTAAAGCACTTAAAGGGAGAGAGAAGAACACAGAAAGTGCTCAGTAA
GTGGAAAGTGTTATTTCCACTGTTACATATAATTAATCAGTGAACTTGGCTAATGTGAGA
CCTCCCTTGATAGACAACTCTGCAGATGATGCCAACAGGCTCAGGTTTTAAGTCTGCGTT
ATTGCTACTGACTCTCATTTCCCTGGTATGAACTGGCAAAGAGCTTATAGTATCGTGTCT
GGGCAGTCAGCTGCCTTCCCCAGGCCACTCCCCTGTGTATGAAATTCTGACGTGAAAGTA
TTAGCGTCCCCGTTTTATGGATAACAGAAACCAATACCTAAACAGACCAAGTGTCCAAGA
TCATCCTGCTAATAAGAGGAAGACTAGGTCTTGAACTCTGATCTCTGACATAAAACTCTG
TGGTTGTCTCGCAGCCCTGGGCTACCTTGTCTGCAATAAGCAGGGGATGACCTTCTCTGT
TCTTGCTGCAGCCACTGCCCTGATGGTTATATCTGCCTTAAAACTTCTGACAACCCGGAT
TTTAACTACACCAGCTTTGATTCCTTTGCTTGGGCTTTCCTCTCACTGTTCCGCCTCATG
ACACAGGATTCCTGGGAACGCCTCTACCAGCAGGTACTGAGCTGCATTCCCCACGCAGA
CTTGGTTGGAGGCTGGTGGGTCAGCTGCATGGCTGTGCTTTTCCTGGAGGAGGCTGACTT
AAATTCAGGGGTCCATGTGCTATGGGTACAGGTTTCTCTTCTTTCCCTTGAACCTGCAGA
CCCTGAGGACTTCTGGGAAAATCTATATGATCTTTTTTGTGCTCGTAATCTTCCTGGGAT
CTTTCTACCTGGTCAACTTGATCTTGGCTGTAGTCACCATGGCGTATGAGGAGCAGAACC
AGGCAACCACTGATGAAATTGAAGCAAAGGAGAAGAAGTTCCAGGAGGCCCTCGAGATGC
TCCGGAAGGAGCAGGAGGTTTGTGAGGAGTGGAAGCTTTGTGAAGAAGGTTGCAGACTGT
CCATTCTTGGATACTGTTCTGGACTAGCCACTTCAATTAGGGCACCGTTTAGGGAGCTAT
AGGAGGAATCATCTTGCCTCAGGGACCATATTAGATCAGGTTTTCTCAAAGAAGAAGCTA
AGTGAGGATTCTTGTGCAAGTGACCTATTGAGGGAGTGCTCTCAGGAGAAAGCGAATGAA
GCAAAACAGAATGGGGCAGAGGGTGGAACTAAACAAGGAGTGTTCTCAGCTAGAGACCAG
CTTCAGCTTGATCCCATGGGGAACTCTGGGGCATGACCTGTACCACAGTTAGTCCTACCT
TGAGGCAAGGGGGCCAGCTTTTTTTTTTTACCCTCCCCATACCTATCCCAGAAGCAGGCA
GCCAAAAGAGACTTTTTTGTAGAATGCTGCAAGTATGAGCCATCAGCTGCTGCCATGCA
AGCAGCTCGGGATAGCTGTGCTGACCTGGTGAAAGGGATCTGGGTGGGGCACCAACAGAG
TACCCCATGAATGAGTGGGGGTGACCCGAGGTGTCTGTTCCTGCCATGGCCTAATCCCAC
CACCACCCTGGTCCTAACCCTTCAGCTTCTCTGTTTCAGATCTCTCACCCCTGGCACCCC
ATGTCTGGGGGACACATTCATGCTAAGTCCAAGCAAATACTATTGGCTACACCTGCTGTT
CTCTCTTCGCAGGTGCTAGCAGCACTAGGGATTGACACAACCTCTCTCCACTCCCACAAT
GGATCACCTTTAACCTCCAAAAATGCCAGTGAGAGAAGGCATAGAATAAAGCCAAGAGTG
TCAGAGGGCTCCACAGAAGACAACAAATCACCCCGCTCTGATCCTTACAACCAGCGCAGG
ATGGTAAGAGGCTCAGGTTTGTGCTCTAAAGATTACCCACCATTGCAGCTGCCGTAGACA
ATGAGTTGGAGTGGGAAGAGGTGTGTGGCAGAGAAAGAGCTGGAGGCATAGAGCCTAAAA
GGATCCAGACACCCCTCCAAATGGTGTCTTAAACTAGGAAAGTGTAATTATAGATGGGG
AAAAGGGGTGAATTATAAGGACACCTTAGGGAAGTGGATCAACAAGATTGGGATTGTGGA
CTGTGGAAAAAGGAAAGGGGAGTCCAATTTGACTCCCAGGTTTCAGGATTGGGCAATCAA
ATGGGTGGTGATTCCAAGATGAGGACACTGGAGGAAGAACCCCGGTTTGTAGGAAAGGTG
GGAAGCCCATACTGAACATGCCAATCTTAAGGTGTCTGCGGACATCAAAGGTCAGCTTC
TTCTGAGGCTCTGGTCTGCAGTTCTAGAGTGCAAGGTTCCCTGTCCGTGGTGCTGAGATC
CTTCATGCACCTTTTTTTTTCTGATGCGTCGAGGTGGTTTTTATTTTTTTACTTAGTTT
TTTTTAATTGACACTTCACAATTTTATATAATTATTGGGTATAATTTCTGACCTCCTTCC
TAAGGTCCTGCAATTCAAGCTGTCACCTGTTGTTATCAGAAAAGTTTCCAGCACCCATCT
CTGTGACACAATCCAGCCTGGGAATGGCTTCAGCACCTCACCTCAGACCCTGTAGCAATT
CTTTTCCCCCCATAATAACTTTCTGCCTCCCACTCTAAAATTTGCACTGCAACTTTCCTC
GCCACGCTTCCTCCCACCACCTTCCTGCCCCTTGAAAGTCCTTTTACCCCAAATATGCCC
TTTCTATAGGTCTGACAGATAATATCTGCTGTGTGGGAGGGTGGCTCCACACTAACAGTG
TGGAAAAGGGGATCAACATGGCTATTTTTTATGCTTTATACCTCTCACTTCCCTCTCAA
TCTCTTTTCCTGTGCTAAGCCGAAGGATATTTTACTTTTTTGCAATACCATCTCTCCAAC
CCTCAGATTTATGTGTGCATATACAAACAGACACACTTGCATGCACACTGACCTCATG
ACACATCCACACTTCAGCATTTATCTGCATCTGTGCCCTCCTCTTTCTTGCTTTGCCCCT
TTTGAGCAGCACCTGGCATACATGGGGCACAGTTCAGACAATCACAGAACAGGATGAATC
ACAGCTTCCATGGAAATGTCAATGACACTGAATTGGGCTTTAATTTCCCCCATTCTGTCA
GCCCCACACAGATTAGCACTTGGATGTCCAATAATTGGTATGTGCTTGTCTCTCCAGT
GATGCTTACTTTCAAAGGGAAAAAGAGGAGCTGTAACTTGTTCATTCAACAATACTAGG
TGCTTGGTATAAAGAGATGACTAGAACATGTTCTTTTCCCTAAGGATTTCCATTTGGGTG
GAGGAGGCAGATATAAACACAGCTATGTGTTAAATAGTGTATTAGAGACACATACATGGT
GTTTTGAGAATCAGGGAAGAAACATCCACTCTTATGGGGCTGGATAGGTATCAGAAAAGG
CTTCCTGGAGGAAGGCATAATTGGGATCAACAATAAATAGCATGTAGGGGTTCTTCTAGT
AATTGAAGACTTGAGAGTTTGGGGAGGAGTATTTTCCTGGCAGAAAGAACAACATGTA
TGTGCAAAGACAGGGAGGCACCATTTAAGTACTTCTTTAATGCTAATTGATTTATTGGAG
CCCACTCAGGAAGGCATCCTCTCCCTCTTTTCCCAGGTACATTCATGTGGTAAATAGACC
TAATGCAGTTTTTATCTAAAGCCATTTTATAACCAATAGAAATTAAATAGAGGAATATAT
AGAAGAGACCCAGGAGGGTTTTTGTGGAAAATCACAGACCAGTTGGTCTCGTTAGAGGAT
GAATTTTAAAGCAATTCTAATGCTTATACTCAGAAGACATTGCCCACCATTTGTCAAAAC
CTTAATTCTAAAATAACTCGTGGCCAAGGAGACACTGCTGTCAAATATGCAACCAAAATT
TTCTTCTCAGTTTCTTCATTGGTTTGCTTGGTGCTCAAGTGCAAATAATGTAGTATTCCC
TTCCTTAATATGGATGTGTCAATTTTTCTCATTTGCTTCAAAAATTGGAAGGATTTTTGC
ATTTTATGAGTTCTATAGTCCTTGGGCATGTATTACAGGCAGAGAGTACTCTATTTATAA
TACTGAGCTTTTAATAATGGTTGCTAAACAGGATCAGGCTTCAAATTATCAAGAGAGGAA
ACTTCAGTTCTGTGAGATAAGGGGATTAGTAAGGAGAACCCCAATTGGCAAGATTCTCCA
CTTTAGTAGCTTAGTAATAAAAAGGAGTTAAGGAAGGTGAGTGGAATAAATCGGTATGAT
CAGAGTTTGGTATGAAGTCAATGTTTAGATTTTGTACATACTATAGACCACCTGAGGACA |

TABLE 17-continued

SEQUENCES

| SEQ ID NO: Human Allele | Nucleotide/Amino Acid Sequence |
|---|---|
| | CAAATGATGGTTTATTATGGTCAAGTTTCACTATGGTCATGGGAACTACCTAACCCAGCA<br>CACTAATTCTCTGAGGGCTCTGGGTTTATGAATTAGCTCTTTTCTCTGGCAACTTTAAGC<br>CACACAGTTCCCTCAATGGAAGATTTTGATGGGAAATGTTTATTGATTTGGAGGAATGAC<br>ATTATTCTTCCAGGAAATTAGGCTGCAACCCTTCCTTCAGTCTCTCCATTGTTGACTGTT<br>CAAGCCTCGAGGGATCCTAGAAACTCATTGCACTGTACAGCTCTTGTCTCCTCCTTTGCA<br>ACACAAACTCTCACATTCATACAGATGGGATCTAATGAATTGTACTACCTAATTTTCAGA<br>CAATGAAGTGCACTTATTCATTCAACAACCACTTACCAAGTATGTTCCAGTACTGGTGTG<br>CATAGTAGCCTCCTTAGGTCACAACTTTGCATGTGGAAAAGTGAACTTAGGACAGCTTTG<br>TCTAGCCCTGTGGCCAAAGGTTGGCAATCAACTGAACTATCCAGGTGACAAGGTTTCCTC<br>TGACATGTTCCTGACCATGATAACCTATTTGCTGAGCATCAGCACGCTGTAATCTCTCCT<br>CTCTCCTGGTCTTTCCCGGAGTCTATCTAGAGTCTCCTTTTTTCTTTTTCCCCACCATGC<br>ATACCTAGAATACCCCTTAGATTTGTGCCTTTACTTAGTGACTGAAAGGTCATAAAGACA<br>GGGGCAGGGAAATGGGAGTAGGTAGAGGGAAGTGTTGGGCTCTAGATTTCCCAGAGGACC<br>AGTTTCCAGCCTTCTTGCTCCTTTGGGGCAATGCCCAGTCTTTTCTAGGCCTCGCCTCTG<br>GAAAACGCCGGGCTAGTCATGGCAGTGTGTTCCATTTCCGGTCCCCTGGCCGAGATATCT<br>CACTCCCTGAGGGAGTCACAGATGATGGAGTCTTTCCTGGAGACCACGAAAGCCATCGGG<br>GCTCTCTGCTGCTGGGTGGGGGTGCTGGCCAGCAAGGCCCCCTCCCTAGAAGCCCTCTTC<br>CTCAACCCAGCAACCCTGACTCCAGGCATGGAGAAGATGAACACCAACCGCCGCCCACTA<br>GTGAGCTTGCCCCTGGAGCTGTCGATGTCTCGGTGAGTTTGTGAATGCTTCAGACTCCCT<br>CAGGCTGTCTTCCACCTAGAAGCCTTGAGCCAAGAAGCCTGAGTATCACCAATGGAAGGG<br>ATCTTTAGCCATCATCCTGTCCAATGCCTCCCCATTCTACTCCTTTTTTACAGACATAGA<br>AGATGAGACCCAGAGAGAGAGAGATTGAGTTGGCCTGAGGTCAAACAGGTTTCCTGGT<br>TTATTCTGCAGTAGTGATGCAAATTATATTCCATTTGACCCCATATTTCTTATCAGTGCT<br>TCTCTGTCCCCACTCAACATCACTGCCTCAGTGATAGGCCTGCTTTCTTGTTGGACAGGT<br>ATGAGAAAACTGAAGGACCCTTCTCTTCCTGCTTATGGCTCTATGCAAACTCTTCTAGG<br>CTGGGCAAATGGCACCCAGAGAAATTCAGGAAGTTTCTTAGGACAGATCTGAATAGAAGC<br>ACAGTATTCCTTGCTTTACTCACAGAAGAAATAATTTGCCAAAATGAGCAAATTAGGCAA<br>CAGTGACTAACTGGCCAGCACTCTTTAATAGAATAATCGCAGAGTGTAATGGCAAGTCAG<br>GGATTCCTCATTGGATTGGGAGCTGTGAGTTAATGTGAGCTCTCCCCTCCAGTTTCAGCA<br>ATGATGTTTCTAGTGTTTTTCATTTGCCCTCTCTGGCTAGCCAGGGATACAGCGCAATTG<br>CAGACAGAATTGTAAAGAGACCAATAAATGGTTCCACTGATACAGATAAGTCTTAGAGTT<br>GCCTTAGCTCAGTCTCTGACTCAATGTCATGTGATTCAGGGTCCCAGCAAGAAACAGATG<br>GACCACTCCGATGGGCTAATAGAGAGAGTTTAGTAAAGTATTTACAGAGGTGTGGGCTGG<br>GCTTAGGGAATGAATAAGGGACAGTGAGGCACCTAGAAACTAGTAACAGGGGGAAGCTGT<br>TACATGCCTAGGCTGAAGGGATGAAGGAAAGGACCAGAATTAGACTACAGCAGCAGCTGC<br>CCTCATGTGTCAGAGAGGCTGCCTGGCAGAACTTGTGATCTTAGTAGAGGATCACAGCTC<br>TGCTACTCAGCCATAGCACAGGAGAGAAGAAGCCAGGGGAAAATACCTGACTTGTCTCTC<br>CTTCTATCCTTGAATGTCCTGCCTATGTCTCCCATTAACCAAACCTGGCCAGAACCAGAG<br>GGTAAGGATAACACATTTTGTACAGGTCTCCCTCCCCAGGAACAGAGACAGTGGAGAAGG<br>TAGAGAGTAGGTCTCCAGGGCAAATGGAATCACCAAAACAGAGCCTTAAAGTCAAGGCA<br>TCCTGCAGGGCTCGCTGGGAGTGCATTAGCACTCTAGAAAATGCCTCACTGAAGGCATTT<br>ATGCCTCTCTTGTGATGGGCCCCCACCCTCCTTTCTCTGTTCCTGAGATTATCATGTGTC<br>TAGATATTCTGACCTTGATTCATTCTAGTTAAATTACCAGGCTAGTGAAAGATTGACTCT<br>TTAGGCCCTTCTGTTTAGTATGGACCTATATTTTAGTCCCAACTGTGCCAGTTACCACCT<br>GAGTCACATTTAGCAAGTCCTTTAAATTATCCAAGCCTCCTTATCTCCCCTTGTAAAAAG<br>GTTTCTAAATAGCTGGAGGGTTAAATGAAATAACAAAGTGCCTACATTTTTATACATGTC<br>TGACAGATAACAATAAATAGTGACTACTAGTATCATTTGCTTAGTCCTCATGGTTGGAAG<br>CTTTATAAACTTTCTTTATGTTTATTAACTGTTTATACTTACAGTATTCAGCAATAACAT<br>GCTGTACAGATTTGTAGCCTAGGAGCAATAGGCCACACTATTTAGCCTAGATGTATAGAA<br>GGCTATAGCATTTGTTTGTGTAAATACAATGTAGGATATTCACAGAATGATGAAATCACC<br>TAATGATGTATTTGTCAGAACATATCTCTATCTGTAAGTGACATATGACTATATATGAGA<br>TTGGCCAATAAGAGGCTGAATGATCCAACTTTGCCATGAAGATGTCAGGTTAAAGGAGCG<br>TCCTGACTCTGTTTGTGTCTCAACAGGCATTCGATGCAGGACAAAAGAAGACTTTCTTGT<br>CAGCAGAATACTTAGATGAACCTTTCCGGGCCCAAAGGGCAATGAGTGTTGTCAGTATCA<br>TAACCTCCGTCCTTGAGGGTAAGTGCTGCTCACTGCATTGTTCATCCACTGTGTCATGAT<br>GAATTCCCATGTGAGCAGCAGAAGCAATGTCTCTAACTCGTGTCAAAGCGTCCATCTCTG<br>TGTACTGGAATTCCTAATACTCCTCATTCTTTATGTCTTAGGCCCCACCATCTTTTATCAA<br>TGTGGTTTTTAGATGCATAATTTTTCAAAAACAAAATAATTTGATGAATAAAATATCCT<br>AGCTCATCTCTTGTTCAAATTAGCATCTGCTTTGCATGCATCACAAAACTAGATTTTTAA<br>AAGTGATCTGGCAGGCATCAGAGAATTTCAGGCCAGCTCTCCGGTGTACAAGAAATTTAA<br>CCATCCTTAATTTTCCAACATGGCAAAATTATCCTTTTCATGGTTTCATAATTATATTTT<br>TCATGGTTGTAACTTACACAGTTGTAATTTAATTTCTTGTTCAAGCCCACATTATGCTGA<br>ATATTGGTAGACAATTTAAGTCCATTAATCAGTCAATTTAACTAAGTCCTTGTTAATTTA<br>GAATTCTACCAATCAAGTGGGAATCCACTCAGTCTCCCCAGCAATGTATCTAAGTTCCAA<br>GCCAAAGGGTAGAGGAAGAGAGTGGCAATGGTCATGGCCACCTATCCACACACTTTGCCA<br>TAGAGCGTGATTGCATCCCTCTAACCTTGAGCAGGAGGTCTGTTCTAATCCAGCCTTTTT<br>TTGCCTTAGGGTATGGAGAATGCAACCTTCATCATTTCCAGTTATCTTACTCCCCTAGAC<br>AAATTAAACTGACCTAGGCTGGAGGAGTTGTAAGGGAGCTTGAGTGCTGGTGTGCCCCTG<br>AGAAGGAGTCCTGTGTGTTTTCCTCCCAGCCCTAGGCTGAATCCTAATTTGAGGGGAAGA<br>AGTGGTGAGCAATAGAAACCAAAAAAATGTTTGAGGGATTTCAAAACAGAGCCAATGTGT<br>GCCCTACTTTCTAGGTAAAGCCAGAGGTGGCAAGCCTTAGAGAGAGATTCACATGCACAG<br>AAACTGTAGAGTAGAACTAGCCAGTAATTTACCAGATATGCAGAGATGTATCTGTTTTGC<br>TCACAGCTGGATCTCCATTACCTAGAAGAGCAGTGCATTAACAAAGGTGATATCTGGGGG<br>GTGATGCTACTTTATAGTGGTGTAAACTGATAAAAAGGAAGAAAATAAGGAATAGTCAGG |

TABLE 17-continued

SEQUENCES

| SEQ ID NO: | Human Allele | Nucleotide/Amino Acid Sequence |
|---|---|---|
| | | TATCTTGGGGTAGGATAGACTTCCGCTCAAGGAAGATACTGTGAGAGTAGAGTAAGAAAG
GCAGGAGAAACAAAGACGTTTTTAAGAAAATCTGGGGAAAGGCAACCTTAGCTTAGGTCA
ACCTTAGGTTAGAGAAGGCCTGAAGCAGCCTCAGAGAGAGCCCTGTGGCTCCAGAATGGC
AGAGAGGAGCTGGGTGATGACTTAGCCCCCAGTGAAGGCTATGGAAAAAGATGAGTGAGA
CCCATAGAGGGAAACTAGAGAGAGAAGAGCCATCTTCATGGACTCTCCCACCAGGGACCA
GATGGGAGCTACAACTCAGGCAAAATACGCTTAGCAATGACAAAGGACCAGCTCAACTCT
CCTCCAGGTTTGAGCCCTACAAAACTCAGACACAGACTCAGATATTGAAATAGTACCCAA
CATTGACTTAACAAGAGACAGTTCCCATGGTGAGGACTTGAAGCATAAATTGAATTCAAC
TAAGTTACATTTCTTGCATACCTGAGTTTGTGCTTTGAGAAATGTGTACTCATTTCTCAA
CAACAACGTGTACAGACTCTCTTCTATTATTTTTTCTCATTGATAATTATTTAATATCAC
TGTTCATTGTAATAGAGTCTGTACTTCTAACATTTTTCATGGCATAGAATTTGACCAAGC
TGCTATTCCCACAATTTCTTTCTTGGCCAGATAGGTTTCTTGGTTTTTGTTTGTTTGTTT
TGGTTTTTGTTTTGCTATTAGTCATCAAACAGCAAACATTGAATACAAACAGTTTGTTTT
TTTCATTTATTCTCGAAAACTGTTAAGCTTCCTCCTTCTCTCTTCTTTCATTTATTCTCT
TATCAACAAGCATTTGTTGAGCCCCTGTTGTGTGTGTGGCATTGCTTCAGGTGCTGGGAT
TCAGTGGTGAACTGATATAAGCTTGCGCTCATGGAATCTACATCCTAGCAGGGAAGGGGA
CATGAAAGATGAATAGATATTCAGATATAAGAAGTAGGAGAAAAAATAAAGTAGGAAAGG
AGATGGAAAATTCTCTCCAAGAAGAACAGAAATTTGAATTAAATAAAGGAATCAGCTATG
TAAGAAGCTGAGGAGAAAGTTCGCAGACACAAATAGCAAGTACAATGCATTCTGCAAGAA
TGAGATAGCAACAAGCAAAATGCATGTCCCAAACACATCCCAGTGTAGGTAAGACAAAAG
AAGGTCATGGGATGAATGAGAGGCAACAGAGGGTAGTAGTTAGAACACTGCTCTGGAACC
CGGCTGCCTGGGTTTGCATCCTAGCTCTTCCACTTATGGTACACAGTGTGACCTTGGAGC
TTCAGTAACTTTTCTGTGCCTCAGATTTTTAGCCTGTAAAGTAGTGAGAATATACTTATC
TTGTAGAGTTTTGTGAGGATTAAATGAGTCAGGTCAAGCAAAATGCTTAGAACCACGACT
GGCATGTAGTAAATACTCATCACATTTGGCTATTATGATTTACTAGGTTGTAAAATCTAT
GAGGGCGGAGATGTGTCTGTTTTGCTCACAGCCTGACCTCCATTACCCAGAAGACAAGTG
CATGCACAAAGGTGATATTTGGGTGGTTGGCGGCGGGAGTGATGCTAATTTATAACAGTG
TGAACTGATAAAAAGGAAGAAAATAAGTAATAGGCAAATATGTTGGGGTAGGGTAGACTT
CCCCTCAAGGAAGATGCTGTGACAGTAGAGTAAGAAAGGCCAGAGAAACAATGATGTTTT
AAAGAAAATCTGAGGAGAGGAAACCTTAGGTTAAATAAAAGAGGTCAAAGTTTTCTGAGC
ATAGGGCACATCATCTTCTCTGGTTGGATGTTATATTCATTACACACATGAGACACCTGA
AGGATGCTTCATGCTGCCAGAGTCGTAATAGGATTTATAAAGGCCACCTCTTTAAGAGGG
ATTATGCTTAAGAAAGTTTGGCCCAAACCAACAGGAGTTTGACAATTCACTGAACTCAAA
GCATGTGAACCTTCTATGCTTGGCATGCAAGCTGAGATTTCACTGTTGTCCAAGCCAGAA
TTCCAGAAGCTGGGTCACAGCAGTGAGCTTACTGGAGTGGTGAGTGCCTTAAAGAGGAAG
TGCAGGATACTAAGTGAAATATGGTAAGATTTGCCTGGAGCCAGGGAATTATCCCAGGCT
GAAAGGACTGCAAAGCAGAAGAGAGAATAACATTTGAAGGAATGAAAAAGCCTAATGTAG
CTGTAACCTAGAGAACCAGGAGAACTGAAAATAAGGCTAGAGGGATGAGTTGGGGCAGA
TCCCAAGAAACTCCTAGACTGCATTAAGGATATGGGACTTCATGCTAAGAGGAGTGAGGT
GCCATTAAAGGATTGGAGGCAGGGAAGTTACATTTGCATTTTATAAAAGTTACTCTGGAT
ACTTGTAGATATAAGAGGGGAAGTATGTTGTCAGGGAAACCAGTTAGGAGGAAGCCAAGT
ACAAGATGGCAGTGCTTGAACTCTGGGGTAGTGACAGTGGGGCTGATGGGAAATGGAAGG
ATATGAGAGCTATCTAAGGGGCATAAGATTCAGGACTTGATGATGCATATGGTTCTGGTA
TAAGTGCCTTAAGATATGCTGATACAATAACTCATAAAGGGAGCATTTTAGGGGAAGAAG
GGGGCTTTAATGGGGAAAGATGAAAGAAGATTATGAGTTGAGTCTGGGATATATTGGGTT
TCAGGTGCCCTTGGAGCATCTAGGTAGGGGTGTCCAGTAGGAAGTTGACTTTAGGATATA
GGGGTCTAGAACTTAGATGACAAAGATGGCATATATATATATATATATATATATATATAT
ATATATACACATACACACACATATATATATGTATATATATATATTTGAAAGCAGTTTGAA
TGTAAGTGGTAATTTTGAAAAGATGCAACTGGATGAGTTAACACAGAAGGGTTGAAGTAA
GAAGAGAAGAAGGCCTCAGACACAGTTCTAACAAACTAAATGTTTAATAGTTAAGCAGAA
GAGATGGACCCAGCAGAGGAGACTGAAAAGGAAGGTACAGAAATAGGAAAAGATCTAGAA
GAATACAATGCAGAGCCAAGAGTAAAAATTTCTTCAGAAAGAATAGAAAGGCCAACAGAG
GCAATGCTGTGGAAAGGTCAGGTAAAATGAAACATGAAAAGGTCCAGGGGCTTTAGTCAC
ATGGATGTCTTTGGTGATCTAAGCAAAAGAGGATTAATGGAGTAAAAGGGTAGGCAGAGG
TCATATTGAAGGGGCTTAAAGAGCGGGTGAGAGGTGAAGAAATGGAGATATGGTGTACAG
ACAATTTTTTCAAGAAGTTTGCCTGTGAGGAAAAGGAGATAGTAAGATGGCACTAGGGAG
TAGGGAGAATTGAAAGAAGACTTTTTGGTTTTTGTGTTTGGGGGAGTTTTTGTTTGTTTG
TTTGTTTTGAGCATATTTGCATGCTAATGGGAAGGATCTGGGAGAATAAGAGAGACTGAA
GATTAAGGGAAGAAAGGGTATATTCAACAGACTCCTGCAGTGGCAGGAGAGAATGCACAG
TGGAGACACTGGTGTTAACAGGAGCAGGGGGACCTCTTTAAGCGTAACAGGATGAAGGGA
GGAAAGTTCTCTCTGTTATCAATTTTATATAGGAGATCCTTTTGAGGTGGGGCCATGGTC
ATGTTTTAAGCTGGCAAGTAGATACTTTTAGTCTCTGTGTCTCTGCAATCAATCAAGTTC
AACAATGTCAAGGCTGTTTACAAAGATGCCTCTCTTTTCCCATCATGCCTCACAGGTGGC
TGCTTCCTGCCAAAATGGCACATCTAAAGTGTCCTCATTCATGACTACTTCCTGTGCTTC
TTTTTAGTGCCAAAATAGGTCCAGGGAAGTTCTTGCTTTTGTTCCAAACAGGGATTGTTG
ATTTTGGTCCCAGGATGTGCCAACTTCTTTAGAGAACTATGCTTTGCCAGTTTGGACATC
TGTAGTTTCTAAAATCCAGTCAGTGATTAAAACAGCATGACAGTGAAAATAAATAGTCTG
ATCTGTGGAAGAGAAATGGACATGTGTATATGAAAACACATGAACATAAATGGTAATAAC
ATGACAAAAATGACATTTCAAATCTTGGGAAAATGAAAAATTATTCAATAAGTAATGTTG
ATATAAATAATCAGAGACAGGAAAAAATAAACCACATCAATATCTTACTCTTTACCCAAA
ATAAATTTCAAATGCACCAAAGTTTTAAGTGAAAAAAGTGAAACTACAAAAGAAAGAAAA
AAACATGGAGAAGGTATTTTCCAAGCCTTGTAGTGAGAAAAGCTTCATATGTAAGGCATG
TATGCATATGTGGCTAACCTGCATAATGTGCACATTTACCCTAAAACTTAAAGTATAATT
TAAAAAAAGAAAAAAAATTTAAAATAAAAAAATGAAGAAAATTGAAAAAAAAGAAAACAA |

TABLE 17-continued

SEQUENCES

| SEQ ID NO: Human Allele | Nucleotide/Amino Acid Sequence |
|---|---|
| | ATAAAAATACTACTGATAAATCTTGACTACATACACATTTTTAAATTATCAGGAAAAAAC
ACTGTTAGCAAAATTTGGGGGCACACAGTTATTTCTCTAAACTGATTTTTCAAGTGCATA
TAGTAAAAAAAAACCCTAAACACTGCAAGTGTGTATGCAATGACAACTATGTCTCCTTCCC
ACTATAGACCCTTCCTGCTCCCCAGACTCCTGGTGCACCCCCCTCCCACTCCAGTTTATC
TTTATATTCTTCAAGCAATGTTCTATGCATATATAAGCACATGCATGCACATACACACACT
ACACATACATATTTTTCTACATCACCACAAATAAATCTGCCTCATTCTTTTTCACAATGT
ATTATGCTTTATCAGTTGTTGTTTTCCATTATTATTATAAACAATGGACATCATCTTTCT
TTGCCCACATAGGCTGATATCTGTTCAAGATGCATGTCTTGCCGAGGAATTTATAGATAA
ACCTAAAGCTAAGAAATTGCCCTCCATCGAGGTGAACACAGTTACACATCCACATGGAGA
TTTAACGGAGGCAGGTAGAGAGATAAGCCTAGTGTTCAGGAAGGGATCAGAAATTGGACA
CATAATTTGGTGGGAATTGGCATAGAGATGGTTTTTTAGGGCTATGAGATTCAAAAACAC
AGAGAAGCTAAGGTGAGAATGCTTGAGTTATTCAACATTTACAAGCAGGAAAGGAAAAGG
GAGACAAAAACAGAAAGTGAAAAGAAGTGGAGAAATATGGGAGAAAAAGCAAGAGATGAT
GCAGTCCCCAGAGCCAAATGAACACTGGTTTCAAAGAGAACAATATAAATTCTGTCAAAT
GTTATAAGGGTAAGATGAGAACTGGAAATCAATTATTTGAATTTGGAAGCAGTTAAAGTC
AGATTCCAGGGGCTGCAGAGAAAAAAGAGGTAAGGAGCTGTAGAAGGTTAAGTGTAGAA
AACTCTTGCAAGGAATTTTACTGTCAAAGAAGCAGTAATGAAAGAGAGCATGGGGTCCAG
AGAGACTTTTTCAAAGCCGCGAGATAATTAAAGCATGTTTACCTGCTCATGGCAATGGTC
TGGAAGGGAGACAGGTCTGGATGATGCAGGCCTTGAATAGGTGGGAGAGGAAAGAGCCCG
GCACAAGTGGGAGGGGTAGAGCCACCCACGCACTGTGTGGGGCACGAAGACAGAATACCA
GGTGGACTTGCAGATATGCCAGAGATTTAGTGGTAGGAAGAAGGGGAAGTTCTTTTGTGA
ACTAGTCTATATTCTGAGTGAAATAAAAGGGAGCTCATCAACAGAGAGTAAGTAGAAAGA
AGAGCCGGAGGTTAGACGGGGGAAGAGGAAGTGAGAAACAGTCATCTGGAAGAATGAAGG
AATGGAATATAATATAGAAACACAGCCAGATTTCTGGGCAGGGCAAGGCTGGGGCTCACA
GATCTCTAGGAGGGTTGGTAAGCATAGTTGTGTATTTTTCCAGCCAGGTCCAGCTGGTT
GGGTGCAAGTACAGAGTAGTCTACAAATTGGGTCTATTCACAGTTCAGGTTTTGCCAGGC
AAGTACAATGAAGGAGGAGAGGGGCAAAGGAATTGAGGGTGCCTACAAGGGAGTAGTTAG
AGAGATGGATGTGAAATCTAAGCTGGGCAAATTGAGAAGTAAGGACATGATATAGGTGAT
GGGCAGTAAAAATATGTAATGTCAGCAGTTTAAAGGACTGGATGGGGCAGATATTAATTG
GAGTTGCAGGACTAAAGGAGTTCAAAATATAGGAAATGAATACCAGAGACAGAGAGAGGG
CTGAAGTCAAAATGTTGGAGGTGGTACTTATTATTAACAACAAGGTCTAGAGGATGACCG
CAGAATTGGGGTCCAAGGTGACACATGGCTGACAGCTGTCATTGACCACACTATAATGCA
GAACTCGAGGAGTCTGAACAGAAGTGCCCACCCTGCTTGACCAGCTTGTCTCAGAAGTAT
CTGATCTGGGATTGCTGCCCCATGTGGGTGAAGCTCAAGACAATTCTCTTTGGGCTTGTG
ACGGATCCCTTTGCAGAGCTCACCATCACCTTGTGCATCGTGGTGAACACCATCTTCATG
GCCATGGAGCACCATGGCATGAGCCCTACCTTCGAAGCCATGCTCCAGATAGGCAACATC
GTGAGTGCTCTGGCTGGTACTGCCCTCACTGGCGTGGTCGGGGCGGGGTGGGGATGATGG
CAGGGTGCAGTTCGGGTGGGGTGGGGCATGCCCTTATTGGTTAGTGTGTTGAGCCAGTTA
GCTGAGAGCAGAGCAGCAGTGCAGGAGACATGTGGACACTGGGTTCAGGAGGTCAAGTGT
GGGAGGACCCAGGCTGAGCTGGTGGGAATGGCTTTGGGATGAACAAGCACAGGAAAGTGA
ACCAGGAGAGCCTGGAGCCAGAGGCAGCTAGTTGCCCTTTACAAAACATAGGACAACCAC
TTGAATTTTCTGGATCTCAGTTGCCTCTACCTTGAAATGAGGATAAATGTCACTTTTTTA
TCTAAAGACAATCTTTGGACTTGTCTGTTTCCTTCCAATGTAATTACTTTTATGACCACA
ATTAACAGTAGCCACGATTTTCAATGTTGTCACTTAAGGAGAAAAAGAGTTGGGGAGGGA
AGGGGAAGACAGTGGAAGGGAGGAAACATGGAAACAAGGTTGCTGTTGTAACAAAAGCAT
CAGGAAGTCGGAACTTTTCTTTGGCATCTAGTTTAGACATCATGCTGCTTTAAATTTTCC
TCCATCACTTGTTAGTATTATTTACTCTTAACAAGATACAATCCATACTGGATTTCACTA
TATACTGGATAAAGTATCTGACTCAGAGGGACAACAACTGCTCCAACCTTGCCCCACCCA
CAGGAATAGTAATAATACTCAGATGCTTCTCATGGATTATCTCATTTTATTTTCACAACA
ACCCTACATGGTAGGCACTCTTGTTATTCCCTTTCCCAGATGGAAAAATGGAGATGCAAA
AGGTTAAATAATCTTCCCAAGATCATAGAGTTGAGTTTAGTGGCCACATCAGAATTTGAA
CCCAGACAGACCGGCTGCCAAGCCCGCTTTTCTTAACCCCTGAATTAAGCCACCTCACAA
GACTTGCGTGTGTGTGTGTGTGTGTGTGTGTGTGTGTGTGTGTTCAAACACACGCACACATG
ATAGGCAGAAGCTAGAAAGGGTCAGCATCCTGCCTTCATGTCCGCAGCAGGGTCCACCAA
GCTGGAGGTGACCTACTGGATTCACCAGAACTGTCTGGCTTTGGGGTCCAGCTTCTTATA
GGCTGCAGACTTAGGTGGAGGGGGAAGGCCCAGAGGAAATGTGACTACTTGTCCCTAGAA
ACCACTCCCTCCGCCATAATCCAGGGCTGTGAAAGGGGCAGCAGTAGGTTCTGGAACATG
GTGGAATCAGCATGCCTCATGTTTTGGCAGCACCTAGGCTGAGGTCACATCCTAAAGTTG
ATATGAAAGGAAAAATGGAAAGAAGAGAATGCTTATTCCCAAGAAGTCAGCCTAAGA
CCACAGAGGGCCTTATGGAATAGACATTTGAGCCCACACCCTCATTCTACAGTTAGAAAA
GTGGAAGCAAGAGAGAGAAAAGGCCTTTCCCACAGTGTCAGAGGAAAGTGCCACTTTTTT
AAAGCAAGAAAGTCATGTGCTTGGTGCCTGCAATGAGTCAGGTGCTTTATGAATGTTATT
TCAGTGTCACAACAACATTATGAGGTTAACATCACCCTCACATGACAAAAGAGAGCACTA
AGACTCAGAGAGGTTAAATATCCTGCCCAAAATTGTATAGCTGGTGAGGGTGGATCCAGG
GTGGACCCAGGTCTCTGGAAGACACAAGACCTCAACCCTACCCCCCACCACACCACACTG
ACTTGCCTACAAGGGACACTCCATAGATACTCTTTGAATCAGTCTTGTGGCATGAGAAAG
TCACTTAAACTCTCAGCCTGTTTTCTTCTCCATAAGAAGGATGCATTGTCTGTTTCTCAG
GCTGGTGAGGGGCTCAGATAAAAGATATGAAGGAAAAGCACCTGACCCTGGTCGTTGCT
TTCCTCCTTCTCTGTCTCCCTTCCCTGCTGGTTGTTGTGTTACCCGAGCCTGGTTCTGAC
CTCTCTCAGTGTCAGAATTCTGTCCTATTTAAGACAATTAGAGACACACAGAGCCTAAAA
GAATCTTAGAGGCAATGAATCATTGTTCTTACTAGTCACTGTTACTTATGAATGAATTAC
TGTCTGCCAGGCCCTTTGTTAAGAACTGCACATGCATTGGCTCATTTTATGCCCATTATA
CAGATGAGGAAATTGAGGTACAGGAAGGATGCATTATTTGTCCAAGCTTACATAAGCTAG
GAAATGTCTGGGCTGGATTTTAATCCAGGTCTGTGATGTCCCACAACCCACACGTTTTA |

TABLE 17-continued

SEQUENCES

| SEQ ID NO: Human Allele | Nucleotide/Amino Acid Sequence |
|---|---|
| | ACTACTGAACCAGACTGACTCTTCACTGACAAAATGATATTATAATAATGATCTTAAAGA<br>CTATCCGCTTATTCCACTCCCACCACCATTCACGTGGAAAAACTGCAGCATGCACAGCCC<br>CTGAGAATGGTGCAGAAATGTCTCCATTCTGTCACGTTGACTGTTACCCTGGCCAATCCT<br>CAGGAGCCCACAGATAACATAGCAACTGAACAAAACAAAAGGATTTTCTATTTTGTAAAT<br>AAGACATTTTCTTGCTGCCATTTTTATCATTGCCTCCGACCCCACAGATCCCACTGTGAT<br>GAAAGCTTGTTTCCACTCCTAGGTCTTTACCATATTTTTTACTGCTGAAATGGTCTTCAA<br>AATCATTGCCTTCGACCCATACTATTATTTCCAGAAGAAGTGGAATATCTTTGACTGCAT<br>CATCGTCACTGTGAGTCTGCTAGAGCTGGGCGTGGCCAAGAAGGGAAGCCTGTCTGTGCT<br>GCGGAGCTTCCGCTTGGTAATGTTTTTCTCTTGATGGCTTGGGGAAACTCCCACCCAGAT<br>TCAGGGAAGACACTGTGCTCTGGGGACTGCACCAGCCAGCTCCCCCTTCCTCTCCTGTCC<br>TTGTGGGAGGGAGCAGGGTCTGACTCCTGGGCGACTGGAGACTTGGGTCTGTGGCCCCAG<br>CTTTTCGCTGACTCAGAGTGGGGACATGCCTTCTCCTTTCTGGGCCTTGGCTCCCTTATC<br>TGCACCAAGAGGGGACTTCCAAGCACTGTCCTCGTCTCTTATCAAATAACAATAACAGCA<br>ATAATCACAGCAGCTAATACTTACTGAGCACTTACAATGTGTCAGGCATAGCACTGGACA<br>CTTGAAAAAACGCACCTCATTTTATGCTCACAACAACCCTGAGAGATAGTCGTTTTTAAG<br>ATCCTCAGGGGTGGGTGAGGAAAAAGAATGGTTCCATGATGACCCGAAAGTCTCCCATCT<br>GCCAAGCAAGCGAATAAGCCACAGACCTGGATCTCAAATCCAGGTTGTCTGACTCCAGAG<br>CCCCAGCTCCTTCCAGCCTCAAGGAAGTCATTCTCTGATTCCCTTGTGCCCGAAATCACA<br>GCCCCAATGTCTCAAGCACCTTCAACCTGCCTATTAGTCTCACTCACATGCAATGATGGC<br>TCTTCTCTAAACTCAGCTCCAGGACGCCCTCTACAGGAGAAGTGCCACAGGCCACCCACT<br>TTTATCAGAGCCACAGGTTTGTCAGCCAAACCTGTCAGATTCCCAGGAGTGTCGGGTCAC<br>TAGGTCTCCAGGCCATCTGGAGGAAGCTTGGCATCTCACTGACTCTTGGGAATAGGAAAG<br>AGGCCTGAAGAAATGTCACGGCTTGTTAGCGCAGGCCGCCTGCTCTCAGGAATCTCTCAG<br>TATTAACTGGGAGCCCTGCATCTAGACTTGAAGAGAGGTGACAAAACAAAGGGGAGTATC<br>CAACAATCTTCCCAAGGTCCTGACAAGTGTTGGCATCCAGAGGTTGAAGGGGTGCATGG<br>TTCAGGAGGCAACGAGACTCTAGGACAGATCTGCTTGGGACCCTATCACAGGGGCCAGTG<br>AGACAGTGCTGAGCCCCTGAACTTGGCGTACCTGGATTAGGGGTGGCAAACTCAAATGCC<br>CATGTGCAGTGACATAGAGCCAGCCATGGAAGAGATGTGGGCACTGGATATTTGCCTCAG<br>GTAGACAGGCAAAGATGACTCCATTTCACCTAGGCAGACCCAAAGCAGTGCACAACTCCT<br>GGGAGGGATGTTTACATAGAAATCAATGTGACCATCTCAGGCCAGGTGCAGTGGCTCACA<br>CCTGTAATCCTAGTACTTTGGGAGGCCGAGGCAGGCAGATCGCTTGAGCCCAGGAGTTCA<br>AGGGCAACATGGTGAAACCCCGTCTCTACAAAAAATGAAAAAATTAGCCAGGCATGGTGG<br>TGCACATCTGTTATCCTAGCTACTCAGAAGACTGAGGTGGGAGGATCACCTGAGACCAGG<br>GAGGTGGAGGCTGCAGTGCACCATGATCGTGCCACTGCACTCCAGCCTGGGAGACAGAGT<br>AAGAACCTGTCTCAAAAAAGAAAGGAGACACAGAGAGAGAGGAATAAAGATAGAAAAAGC<br>GAGAGAAAGACAGATGAAAGAAAGAGAGAGAGCAAGAGGGGAGAGAAAGAAAAAGAGAA<br>AGAAAGAAAGAAGAAAGAGAAAGAAAGAAAGAAAGAAAGAAAGAAAGAAAGAGGAAGGGA<br>GGGAGGGAGGGAGAGAGAGAGGGAGGGAGGGAGGGAGAGAGAGAGGGAGGGAGGGAGGGA<br>AGGACGAGCTATGGCCTGTCCATTATTGTCAGAGTTACTAATTTTCCAAAAAAGTCAGAA<br>ATCCAGATTTTTGTGCAAATGTCTTTAATATTGGCTACTAATCCAGTTTTTAAAAACACT<br>CTAAAGACCAAATAAAGCATGTCCTGAGACACAGCTGTGCCATGAAACGCTGGTTGATGG<br>CATCTGCCTAAGCTGATGGTACTGTCACCATCCCAGGGAGGAGAAGGGTAGAGTAGGCCT<br>GGTAGGACTCTTTATCCATAACTTGAAAATCTTACAAGGTCAGAATTAAATCACATTTTT<br>AGAAGGACAGATTTCTCTAGGTATCTAGAAATTGATGTCAAGATGTAGGCCCCTAAGCTA<br>ATGGTCAATATAAGGTACCTATGCACAATCGTCAAGAGAGCAGGAGATATCACACCCCCA<br>TACCCTGGCAGGCCCACAGTTAGTTTTCTAATAAAATACGAGGCTGGGCGCGGTGGCTCA<br>CGCCTGTAATCCCAGCACTTTGGGAGGCCGAGGCAGGCGGATCACAAGGTCAGGAGATCG<br>AGACCATCTTGGCTAACACGGTGAAACCCCGTCTCTACTAAAAATACAAAAAATTAGCCG<br>GGCACGGTGGCGGGCGCCTGTAGTCCCAGCTACTCGGGAGGCTGAGGCAGGAGAATGGCG<br>TGAACCTGGGAGGCGGAGCTTACAGTGAGCCGAGATTGCGCCACTGCAATCCGGCCTGGG<br>CTAAACAGCGGGACTCCGTCTCAAAAAAAAAAAAAAAAAAAAAAAACGAACATTTCTGC<br>TACACTTGGGGAAGCAGAAGCTTAGTGTTTTAAGGTCTATGTGCTACTTTTGTTCTGATC<br>CCACAGTCTAAAGTCCCAAACAACCAAAAATAGGCAAGTTTACTTCACAGTCTGCCCCTA<br>CAGGATTCTGCAGGGGAATGCTACCCTGTCCCCACCTCGCTGATTTAACATGCTGATCAG<br>TGCTCAATTCCCTAACCACACCCACCAACTACACACTTTCTTGGGATCTATTCCACTTCC<br>CTCATGACCTAGCTTAGATTTCACAGCCCACCAATATTATTATGCCCTTGAAAACAAACT<br>CAATCACCTTTTCCCTCTGCCTCTTTGCGTTTTTGTGTTTGCCAAAACCTCACCGGAGAG<br>TCTAAGTCAAATATTTCTCTCCACCTTGTCTGCACCTGAGCTGTGAGAAATGCTGGAGAA<br>AAATCACCGCCAGCTGGTCAGTTTCCTGGTTTTAATTAATAGACTTTATTTTCAGGACAG<br>TTTTCAGTTTTCAGAAAACTGGAGCAGATTGAACAGAAAGCTTTCATATACCATCAATCC<br>CACAACACACACACACACACACACACACACACACACACACACAGAGTTTCCCTA<br>TTACCAACATCTTATGTTAGTACCTACATTTGTTACAAATAACTTCACTGGTTTCCCATT<br>GCTCTGAGAATAAAATCCAGACTCCTCATGATGGTGTACAAAGTTCTGCATAATCAGGAC<br>CTGCCAGTTCACCAGTCTCCGTCTTGCCCACTTTGCTCCAGCCAAAAGGCCTACTCTCT<br>CTTCTTCACACATAACAGAGAACTTCTTGGCTTTGGGCCTTTGAAGTTTTTTTCGCTGTG<br>CCTGGAATACTTTTCCTTTAGTCTTCACTTAGCTCACTTATTCTCAAACTCTGTGTTCAA<br>TGCACTTGTCACCTCCTTAGAGGGGACCTCCCCAACCACACTATCTAAAGTTGGATTCCT<br>TCATCAAATTAACCTGGCATTTACAATTGTCCTGCTATCCCATGAGGCAAAAACCAGAGT<br>TTCTTGTCTACCGTTTTATCCCAAGGGCCTAGCACAAGGCCCAGCACATACATAGGAACT<br>CAATAAACACCTGTTGATTGATTGAAGGAAGGAAAGAAAGAGGAAGGTGGAGGGAAAA<br>AGGAAGAAATAAAAGTCTGTCTTCCTTCTCTCCCAAAATAGCATTGCTTCTCCTCCCGT<br>CACTTAAAGCCTTGCTCCATTTGCTCTGTTAGTCCATTGGTCTATCCTGGCACCAATATC<br>AGTCTTAATTATGGCAGCTTTAAATATATCTGTGTCTGTAAATCAAGTAATCCACCTAAT<br>TTACTTCAAGAATATCTTGGCCTGCACACTTTCATATTCACTTTAGAATTATCTTGCCAA |

TABLE 17-continued

SEQUENCES

| SEQ ID NO: Human Allele | Nucleotide/Amino Acid Sequence |
|---|---|
| | GTTACATACCCACATACACACAAAACTGCTATTGTTTTCCCATTAGGGACTGCTGTAAT
TGATAGGTCAATTTGGGAAGACTTATAATCTTTACATAATTCAGTCTTCTGATCTATGAA
GATAGTATACGCTGTATACCAGTCTTTCAATAAAGTTTAAAAATGTTTCCATGAGGTTTT
TATAATTTTCTCCATAGGATCTTGCATATCTTCTTAAATGTTCTTTTCTGGCATTTTTGG
CTAGCATTTTGATATTTAACATTTTTGTATCTAGAAATGTCTCTTATTAATTCTAATAAT
TTATCTATACAATGTTTTAAATTTTCTAACATAATCACATCATGTGAAAATAACAATGAG
TTTAATTTCTTCTTTTCTTTCTTTTTTTTTTTTTTTTTTGAGACAGAGTCTCGCTCTG
TCACCCAGGCTAGAGTGCAGTGGCGTGATCTCGGCTCATTGCCAGCTCCACCTCCCGGGT
TCACGCCATTCTCCTGCCTCAGCCTCCTGAGTAGCTGGGACTACAGGCACCCACCACCAT
GCCTGGCTAATTCTTTGTATTTTTAGTAGAGACGGGGTTTCACCGTGTTAGCCAGGATGG
TCTCGATCTCCTGACCTCATGATCTGCCTGCCTTGGCCTCCTAAAGTGCTGGGATTACAG
GCATGAGCCACCCACGCCCAGCCTAATTTCTTCTTTTCTAATCCTTATGCCATTAGGTTC
TTTTTACTAGATCACTGTGCTAGTTAGGACATCCAGTACACTGTTGAAAAGAAGTGTTAA
TAACAGGTATCTTTATCAATTTTCTGATCCCAAAAAGAATCCTTTCAATATTTCACCACC
TCTAACAATTGTGGCAGGCTTTTTTAAAGATAAGAAATCTTTATCAGTTCAGGAAGTTC
TCTTTTATCAAGAATATTTATCATGAATGGATGTTTAATTTTATCAGACAATTATTCTAC
ATGTATTGAGATAATCATGTATTTTCTCCTTCAATCTGTTAAAGTGGTGAATTATATTAA
TTGATTTTCTAATGTTAAATCAACTTTACATTCCCAGCTCAAACCTAGCTTGATCGTGAT
GCATTTTTTAATACATTGGAAGATTTAGTTTGCTAAAAATTTGCTTAAGATTTTTTATC
CATATCAATGAGTAATATTTGATCTATAATTTTCCTGACTTTCATTGTCCTTGCCAGGTT
TTGGTATCAAGGTTCCAAGATTATGCCATTTTTTTTTAAAGCCAAGGGGCCAGGTGGG
GTGGCTCACGCCTGTAATCCCAGAATTTTGGGAGGCCAAGGTGGGAGGATTGCTTGAGGA
CAGGAGTTGGAGACCAGCCTGGCCAACAGGAGAAAACCCCATCTCTACTAAAAATATATA
AATTAGCTGGGTGTGGTGGCACACACCTGTAATCCCAGCTACTCAGGAGGGTGAGGCATG
AGAATTGCTTGAATCCCAGAGACAGAGGTTGCAGTGAGCTGAGATCATGCCACTGCACTC
CAGCCTGGGCAACAGAGCGAGACTCCGTCTCATTGAAAACAATAAAAAGAAGGCCAGGGG
CAGTGGTTAATGCCTGTAATCCCAGCACTGTTGGAGGCGCAGGCAGGCGGATCACCTGAG
GTCGGGAGTTCGAGACCAGCCTGACCAACATGGAGAAGACCCATCTCTACCAAAAATACA
AAATTAGCCAGGTGTGATGGTGCATACTTTTAATCCCAGCTACTTGGGAGGCTGAGGGAG
GAGAATTGCTTGAACCCGGGAGGCGGAGGTTGCGGTGAGCTGAGATTGCACCATTGCACT
CCAGCCTGGGCAACAAGGGCAAAACTCCATCTCAAAAATAAATAAATAAATAAATAAATT
TTAAATTTAAAAAAGAAAAGGAAAGAAATTAGCTGGGCATGATGGCACGTGTCTGTAGTC
TCAGCTATTTGGGAGGCTGAGGTGGGAGGATGACTTGAGCCCAGGAGGTCGTGGCTGCAG
AAATTACAGCATAAATTAACTCTCCATTAGTTAACTTAATCAAAGCCAAAAGTTAGCTAA
AATCTTTAACCTTCCTCCAAGACAACTTTTCATTCCAGATATCCTTTCCCAATTTATTGT
AATGATAAGTATTTTAATTTTATCTTGTTTATAAAAATTTTTATTAATCAATGAAAAATA
AAGCTACCTATTATACAGACAATCTCTAAAACTGAGTAACTGACCCCAATAAAGGTTTAT
TTCTCACTCGTATCATAGCCTAATGCAAGCCAGACAGCTCTAGGTGGGACTCCAAGAAGT
GACTTTGCCATGCCTGAAGGAGGCCAATATAACTTCAAAGTTTGCCTCCTGCTTGTGGGA
AAATGGAAAGCCAAGGTTTGTTTTAAGGTTTAAACAGTGAAAGGCTTTTTCAGTCAGGGA
TTTTGATTTATTTCACAATACAATTACTTCAAAAACTTAGATGGCTTCAGACCTCTCATT
GCCACACAAAGTGCTTTCTTTGACAAAGTTCTCAATTGTTCTTTATTTCTTTGCTTTCCT
TTCCCCATGCCTTTCTCTTGCACAAGAAACAGTGGCTACACCATTACTACAAGCTTTGCT
AAGAGTTGTTTCATTTAATTGGAAAATTTAACTAGTCTTCAACATTTGAAGACTTAATCC
CATTGCTCACTGCCTGGAATCTAGAAGCAGTACAGTTCCCTAAATCGTCAAGGCTCTAAA
CTTCTGGATTATATTTCTTTTATTCTTATAAACCAGCTAAATCTTTCCTGAGCTAATCT
CTTTCTTGTACTGTCTTGACCAACATAGCCAATTACAACTGACCCACAATACTAAGGTTT
AATAAACCCTTCCCCTAGGGTTGCTGGTTCATGAGGCTCGTGCTCTGCCTCAAAATTTTT
GCCAGCAATATTTTTGTCACTGAATAACATAGATTGACATTCCAAGCCTTCTCCTATCAG
CTTCCTTGTTGCCCACCACATGATCATTAAGCCAGTGCCACATAGTTGATGCTTTTGAAA
AGGCAATACCTTTTTTCAATGAAGCAATTTCTCCATTACTCAAGATAAGTACAACTAGCT
GCAGTGATACCCTCTAAATCTGTGAGTTAACATAATAGAGATGTATGTCTCACAGCACAT
TCAGTGCTTGTTGGGAAGCTCTCCTGGGAGTGTCTACTTCAAGTAGCGCCTCAAGGATCT
AGGATTATCCCATATCGTGATGTCACCATCTTCAGTTAGTGACCTTTATGGTGAACATGA
AAGGGAAAGAAAAAGTTCAGGGGGTTTAAGGCTATGCCTAAAAGTCATGTATATTACTTC
TGTCTCCATCTCCATTCCACCAGACAGAACCCACTAACATGACCCCAACTATTTGCAAGC
AAAACTGGAAAACAGTCTTCCGTTGTGTCTGGGAGGAGAAAAGTGAATGGAGACTATATG
ACCAGTCTCTTCCACATCTCACAAGACATTGTTGTTGTGTCCACTCAATGTTTATTTAGA
TTCACTCTCATGCTTAGCACTTTCTTGCTCTTTATACCTTTGTTATAGAGCCAGTGGGGG
CTCACTGCCCAATGCTCTAGAAGCCAATACTATGACTTTGGAAGCCAAGACGAGGACACC
AGGCTTTTGAGAAAAGAAAAGCTTAATACTGCAAGCTGGCTGGCAAGAAGACAGGAGGTC
AAGCTCAGATCTGTCTCCCTGTGCTGTCTTCAAGGCAGTATTTTTATTAGAAAATGTTTA
GTGGGTGGATACCGGGATTTGCAGGTGATTGGTGAAGGAAAGGGGAGGTTTGGAGAGTC
CATGGGCCTGCACAGTTATCTCTTCATGCTTACTCATGGGTTGCATATGCAAATCTGGGG
GGAGTTAGTATGCAATATGAAGTGGAAATTCAGTCCATGACGTCAGCAAGCTCATTCTGC
ACAAACTCCAGTCGGCCATCCTGGTTCCAATTGATTTCAGCCTGTTTTTTCATCATCACA
CAAGGGGAGGGAGTTTCAGTGTCTCAGCAAGTTGTTTCTTTACCTATCTGCTATCCTAAA
AACTCAAGAATTTTTGTAAGTTACTGATTTCTTACTCTTTGGAACACAGTTTGAGTTTCA
GATTTTCAGTGAGTTATTTCTTATCTGGTATCCTGTAAGCCTAAAAATTTAGTTATTGAT
TTCTTCAACCCTTTGGAGCACAGTTTCACATTCTTGTATATTACACATTACATATTACTT
CTGGGATCACTTTCTATCTACCTGAAGTACCTCCTTTAGAATTTCTTTTAGTAAGTGCCT
TCTGGCCATAACCTCTTTGTTTATCTGAAATTTGCTCTTCAGTTTGCCCGTGTCTTTGAG
AGACATTTCTTATGAATGTAAAATTCTAGTTGATACTTTATCTTCCTTCAGTGAAGATAG
TATTCCAACAATTAGCCTCCATTGTTGCTAATGAGCAGTCAGCTTTCAATTTAACTGTTA |

TABLE 17-continued

SEQUENCES

| SEQ ID NO: Human Allele | Nucleotide/Amino Acid Sequence |
|---|---|
| | TTCCTTCCTTTCTGGATGCTTTTTAAATCTTCTATCCATCTTTGGTGTTCTGCAGTTTCA |
| | CTGTAATATGTCTAGGTGTGGACTTCTTTCCATTTATAATGCTTAAGATATACTGACTTC |
| | TTGAATCTTTAGTTTTGTAATTTTCTTCAATTCTGGAAAGTTCCCAGACATGATGTGGGC |
| | AGTCATAGCCTCCACGCCATTCTATTTTTTCTCCTTCTGGACTTTGGTTAGATAGATGTT |
| | AAACTCTCTCATTCTATCCTCTATGTCTCTTACACTATTTTGTTATTTTTCATCTTATGT |
| | CTCTCTAGGTTACATTCTGAATAATTTATTCTGATATATCCTCAGTTCACTAATTCTCTC |
| | CCAAACTGTGTCAAATCTGATGCAAACCTTCTTCATAATATTTTTAATTTTAAGTATTAT |
| | ATTTTTCATTTCTAAGAGTGTATTTTTCACAACTTGTTATTGTTATCTATAGTTTTTTA |
| | TTCTCTGCACATAGTTTCAAGTTATTATTTTATTTCTTTAACATATTTATATCTAATTATA |
| | CTGTTATCTCTGACTAATAATTCTATCATCTGAAGAAATGGAATGACTATTTCCACATCT |
| | GTGGTTTCTTCAAGATCTCATTCACTCTTGATGACTCATTCCTTCTGTTTTTGTTTGTTT |
| | TTTTACTGCAACTCTTAAACAATTTTTGAGGGAATAGTTTGAAACCTGAGATAAAGGCAG |
| | GTTCCTCCAGAGGTATTTGCATTTAATTCTGCAGAGCACTTTGTAGAATTGCTCTAAATT |
| | AAATTCTCAACTTAAAATACCTAGGTAGTGTGAATTCCAGATAAAATCCTATATGAGCAC |
| | CACTTTGTTGTTTCAAATGCTCAGCGTCAATTTTCCTCCTGTAGCTGGTACCTAACACCA |
| | GCCATTCAATTTTCCTTGCATTCTCCTGGGATTGTTTGTGGTTCATCCTTACATGAAGGG |
| | TATAGCTCTTTGGGATCTAGTCTTAAAGCAGGGAGAAATTCCTGCTAGGCTTACAACCTT |
| | CGGCAGGCCATGGACTACGTTTCCTGCTCCCCATACTAGTTACTAATGCTCAGTTTTTAT |
| | TTGTGTTTATCAGCTGCCTCTGTGACCAGTCCACAGAGTTGTTGTTTTAAGCTCTGCTTC |
| | CCATATGAGGAGAGTAACTTCCAGATTGGGTGTAAGGTGAACGTGGACCCGCTCTCCCCC |
| | ATCACATAAAGAGGTGCATACAGCACTTACTGTATAACAGGATTAAACCTCCTCCCGTGG |
| | GATTTACTCACGGATATGGGTGATAAAATTGTAGCTACACTGTTGTGTTCAGCATTGCAT |
| | CCTAGCACCTAAGCCACAGCCTGGCTCTTAGTAGGTGCTCCATAAACACACCTTGACTGA |
| | CAGACTGACAGTTGAGCTCAGATTTTTTTCCTGACAAATTAGAGAACCATACAAATATA |
| | TTTTAAAACACATACATTTTTATGCTTGATGATTTTGCTGTCTTGTGGGACTTAGCATAT |
| | TTGAGTTTACAGTGAAGACTTTTGAGACTTCATCTTTTCTCAGTAACTAAACCATTGGTT |
| | CCATGAGAGCAAGAGCCCACACACCTCTCTTCATACACCTCATAGGCTAGCACACTGCCA |
| | TGCACCTGCACGGCTGGAGTTCTGGGGGGTAGGTTCGTTGGTCAATTAAATCAACTTATG |
| | AATGCTGAGTCCATGAAATCATGGACATTTGCAGTTTCAAAGCTGGTGGGAGCAACAGAT |
| | GTTGTCCACTGCCCCAAGATGAGAAATGCCCTAAGAGATGTTTTGCCAATACCTATCGAA |
| | TGCAGTGGGTCATCCCCTACCCGAAGGAGGCTGGTCTCTCTTCAGTCATAAATAAGCTTG |
| | TTCTCACTTATTTGTGAGCCCCATCACACCCACCCCACCTCCACAGAAGAGGCCCATATT |
| | CAGGAGGGATCAGGCCTGTGGCTATAGAACAGAGTACAGATCGCAAGGCCACCACCCCAG |
| | TAGAAGACCCTGACTCAGCCACAGTCAATGAAGCACATTGATACTTATGAACCATAGAAG |
| | GCAGATCATATTTTGAGTAATTTATAGCATAGGAAGAAAGGTCTCCAAAAGCAGTGTCC |
| | AGAAAACGCCCTGGTTTAATGGGATGAGAGGCCTTTGTGTTTTTCCCAGATCTTTGGTTTC |
| | CAGGCAAAACTTTAGATGAAAGGTAATGAGCACAGCTACCAAAACCTGACGGTCTCTGTT |
| | TCTCTGCAGCTGCGCGTATTCAAGCTGGCCAAATCCTGGCCCACCTTAAACACACTCATC |
| | AAGATCATCGGAAACTCAGTGGGGCACTGGGGAACCTCACCATCATCCTGGCCATCATT |
| | GTCTTTGTCTTTGCTCTGGTTGGCAAGCAGCTCCTAGGGGAAAACTACCGTAACAACCGA |
| | AAAAATATCTCCGCGCCCCATGAAGACTGGCCCCGCTGGCACATGCACGACTTCTTCCAC |
| | TCTTTCCTCATTGTCTTCCGTATCCTCTGTGGAGAGTGGATTGAGAACATGTGGGCCTGC |
| | ATGGAAGTTGGCCAAAAATCCATATGCCTCATCCTTTTCTTGACGGTGATGGTGCTAGGG |
| | AACCTGGTGGTGAGTGGTGAACCCTGCTGGGGGCACTGTCTCCTGGGGAAGGAGAAGGC |
| | TTCTGGGTTATCTGAAAAAGCTTTGATCTGCATTTTTATGCCCAGATTGTACTTCTCTGG |
| | TTGAAAAGTCTTCAAACTTTTCAAATTCATGTGGGATTCATTACAAGAAGTGTGCCTTGG |
| | GAGGCAGTCTGACTTGCAGGAATGAGAACATATGATTAGAAAAGAAAGACCTGGTGTAGA |
| | ATCTCTGCTCCACCATTTACTAGGTGGGTGACCCCAGGCAAGAGACTTAATCTCCTCAAG |
| | ATCTAATTTCCTTAAAATCAAGAAAATAATGCTTACTCATGGGTTTACTGGGAGAATTAA |
| | ATGACAGGAGATGACATATGCAAATTGCCTAATGCAATGTCTGGGCTGAGGCAGGAACTC |
| | AATAAACGGTGTCTATTAGCTGTTAAAGGAAAAATGTCCTTCCCCAATCTGAGGGGCTC |
| | AGAAAACATTTTTATTCAGGGAAGTAAGAGCTGACTGATTTCTCCAAGCTGCACAGGTCC |
| | TAGCTGGGAGCAGGGGGAGAGGCTGCAGGGAGGGGGCACAATGGGTCACGGACAACATCC |
| | AAGGCCACAGAAATAATAACAAAATCTACTCCATGTTTGGAGGAAGCCCCTCTGGAGACT |
| | CACTTGCCAATAAGCCCCAATACCCCTTCTCCGCCCCAGCCTGGCCCCCTGCCCTCAGCT |
| | TGTCTCCACCCACTCTGGTCATGGTGGGGTCCTTGCCCTCCTGGGACTGACTGGTTGTGT |
| | GGGAGGATGCAGTCTTCCAGAAGCCCCTTTCTTATTGCCCTGGACATCAACCAACTTGGG |
| | TTCTTTCCTCATGAGTTTTATAGACAGAAGAAAGCTAAACCAAGAAAAGGGAAGCAACAA |
| | CAAATCCAGACTCTTTAGTCTTTTCCACCCTGGTGCCTGAGCCAGGGATGCCTCTGCCTG |
| | CATCCCAGAAACTCTGTTCTTCCAGGCTGAGCCCACCATCCCTGCAGAGCCACAGATGCC |
| | CCTCACCCTCAGACAGGAAGTTTACCCCTCTGAGCACTTTTACATTTCTCATATCATTTT |
| | GTCTTCACAACCGCTCTTCATCTGCTCTCAAGTGAAGAACTGGAAGCAGCAAGATGTGCC |
| | CAGGATTCCAGAGTCAGGAACAGAGCCCAGGGCTTTGGCACATGAGGGTGGTTGCAGGAA |
| | GGGCTGGTGCCTTCTCTCTGTTGTCCCTAAATGTCCCTCTGCTCAGCGGGGGCTCCTCC |
| | TTTATGGTGGAAAATATGCTTCCAAGCCTCGTCCACTGAGGCGGGTCACTCCAGGACATC |
| | CCCAAACTTTCCCTCAACTGCTCTCAGAAAGTCCATTCCCCCAAAAGGGACAGCATCCCG |
| | GGTGGGCAGGAAGAGGCCCAGGCCGTGGCTGTCTTGCCAGCCAGCTGCTAACCCGGTAGG |
| | CCAATGTGGGCTCAGCTTAGAGATTGATCAATCTTCCCTTCCATTCCTTCTCTTCAGGT |
| | GCTTAACCTGTTCATCGCCCTGCTATTGAACTCTTTCAGTGCTGACAACCTCACAGCCCC |
| | GGAGGACGATGGGGAGGTGAACAACCTGCAGGTGGCCCTGGCACGGATCCAGGTCTTTGG |
| | CCATCGTACCAAACAGGCTCTTTGCAGCTTCTTCAGCAGGTCCTGCCCATTCCCCCAGCC |
| | CAAGGCAGAGCCTGAGCTGGTGGTGAAACTCCACTCTCCAGCTCCAAGGCTGAGAACCA |
| | CATTGCTGCCAACACTGCCAGGGGAGCTCTGGAGGGCTCCAAGCTCCCAGAGGCCCCAG |
| | GGATGAGCACAGTGACTTCATCGCTAATCCGACTGTGTGGGTCTCTGTGCCCATTGCTGA |

TABLE 17-continued

SEQUENCES

| SEQ ID NO: | Human Allele | Nucleotide/Amino Acid Sequence |
|---|---|---|
| | | GGGTGAATCTGATCTTGATGACTTGGAGGATGATGGTGGGGAAGATGCTCAGAGCTTCCA<br>GCAGGAAGTGATCCCCAAAGGACAGGTAAGAGTTATCCCCAAGGGACAGCCACAGGCAGT<br>GGGGAGGGGCTTCAGGGCTTGAGTGACAAAGGGCAAAAGGGAAATGCAGAGGAGACCTTG<br>ACATAAAGAAGTTTAAACCATGCCAAGCTTTCCAGAGGAGTTGGCGTTTGAGCAGGGCCT<br>GGAAGAAAAAGTCAGAATTCCCCAGGCAGACAAACAGGGAGTGGGGGGCAGCAGGTGAGC<br>AAAAGGCCACCTTGAGGTGCTTGGGGATTGTCTTTCACACAGCTGTCCCATGCGCTCTGC<br>CCAACCCAGGCTCTGTGCATGAGATGCTAATGAGATTTCTCTAAGAACAGGATGTTGTCC<br>AAGAGCAAGGCTCATCTAATCTTTACCAGCATCCTAAGAAGTCCTGATTCTTATGTGACT<br>CATTTAGCCAGCTTTTCCCCACAAGTGGTATCACAGGGAAATGACACGCTCCTTTTGGCA<br>CCAACTAATTTAAAGCACATTTGAGCCATTTGATAATATATATTTTTAAATACTTGGCAC<br>TATTCCTTACTACCTTAAGCTGGTATATCAACCCTCGCTAACCTCTTCTCAGTAACTCAG<br>GGCATTCACCTCTGCCCAACGTGGGAAGGCAGGGAACCCTGTGAGGCCTCAGGAACATGC<br>AGGGCTGCTGGCCAGGTTACTAAGTGGTCCAGAAAAGCTGTGCTTTGAGTCTGTAGCTCT<br>CCCATAGCCTTCTTCCCTGCAGTCGTCACTTGTGTTCCAGCAGCTGCTGTTATCAGCTGC<br>CATATTTTACATGCCTTTGTCTAGGTAACAGCAGAGAGCATGAACTCTGTGACAGCTGTC<br>TGCCACTCAGAAGCATTTTCAGTTACTTTGGGGCTCTTAGGGAGCTCCAGGTGGCCAAGT<br>TCCCTACAATTTTGACCTCTGGACAAATAACAATGGTCATGGCTAAAATCTATTGAGCCA<br>AGCACTTCGTGCAAAGTGTTTTACAAGCGCTAACATATTTAGTCATCAAAACAGCTGAAT<br>GATGCAGATCTAGCCTTTTCAATTTTGAAGCTGGGAAAAATGAAGATTAGAGAGGTTAAA<br>CAACTTGCCTAAGGTCACACATCTTATAATTAATGGAGCCCAAGGATAAAACATAGGTCT<br>ATCTAGCTATAGTCTTCATGCTCACTTCACACACGTGTATGTATATATGTATGTACATGA<br>GTTGCATATATGAAACTCTTGGCTCTGGCAGCCTGTGATGTGCAAGATCCCTTCAAATTT<br>AGAACTGGTCATCTAAGGGTGGGGCCAGGCACCCAGTTGGGACCCTCTCTCACTAGCAGG<br>AGCAGCTGCAGCAAGTCGAGAGGTGTGGGGACCACCTGACACCCAGGAGCCCAGGCACTG<br>GAACATCTTCTGAGGACCTGGCTCCATCCCTGGGTGAGACGTGGAAAGATGAGTCTGTTC<br>CTCAGGTCCCTGCTGAGGTAGGTATGTCAGCTTCCTGGAGAGGTTGGACAGCCAGCCAGA<br>CACTGAGCAGTGGGCTGGTAGAGGCTGGAGGGTGGCGGTGAAGGTGGGGTATTCCAGACT<br>GCACTCAATCACATAACCTCATTTCTTATCCTGGGAATTTTTAAAGTCCCTCCCAACCTC<br>CGGCTAATCCGCACAATTTCAACTTTCACCATATACCATTGCCACAATCTCACTCCAGGG<br>TGGTTCTAGGTATAGAAAGAAAGAGTGAGACTCCACAAGCTGTGGGACCTAAGATCAGTT<br>CCCAAACCTCTCTGAGCCGCCATTTATTCATCTATGAAACTGAATGGTAATGCCTACTTG<br>GTAGGATTATTTTGAAGCTTAAATGAGATGCTGCTTGTCAAATGTTTAGGTCCTGCCTGA<br>GACAAAGTAAGTGCCCAGGAAATGACAGCCAAGAAAAAAGGAAACGAAAGACAACGCACA<br>AAGAAAGTCAAATATCTTTCAGAGCCAGCAAATAAGAGTTGGAGGTGCTCACAGATGAAG<br>AAGTTTTCCCTTGTGATTCTCCCCCACTTTCTTTTGTCCACATCATTTTCTCTAGGCAAA<br>AGTAGCCTGGGGCTAGGGAGAGGCTCTCTATAGGTGAGTAGTGAAGTGACAGCCTCACAG<br>AGACTGAGCTGGAAGATTAGAGGTTTAGGATTGTCTTATACAAGGTAAAAATAAATGTGG<br>TTTCACTTACAAATCTTGAAGGAAACAAGCTATAGGGAAAGAGGCATCTATAAAAGTTTA<br>GCATCTTTAATAACACTGCCTTCAATTCAAGAATTTAATTTGACACCTAGCCACTGAGTG<br>CTGACTTTGTGACAGGCACTGGGCTCAACAGAGATAAGGAAGTCATAATTCATCCCCAAA<br>GTTATCAAGCCCTTCAGCTTGAAGAATGTCAGCTACTGGCTGTGTGCCCTAGGCAAGGCT<br>GACCACAGCAGGGTAAGATAAGAGGGAGGGCTGGGACGGGATTTGGGGGCTGTGGGTGAA<br>CAGAAGCCGCTTGGTTCCCACTGGGTGAGGGCTGTCACATTCTGCACGTGGATGTCATGC<br>TTCTTCCCAAATGTTCCAAGGACTCCCCTGGCTAGTTGTCCCTACTCAATGTTTTCAGTA<br>CACAACTTCTGGGTGTTGGTTTTTTGTTTTTGTTTTCTTGTCCATGACCCCGGCTAGGCA<br>GGAGGGGCCTGACAGCGACAAATGGGGACCCGCCCCACCATTTGGGTCCATTAGCAAAGC<br>TATCAGGTTTACTAATATGAGAGCAACTTCAACCCCTAATTGAATTCATCTGGAGACATT<br>ATAGGGCTGGAGCTGCCAGGAGGGCAGCAGGCCCCTGCAGCATTACTCCATGATTAAATA<br>TTCAAGCCCAGTGAATGCTGAGAGTCGTTATGGGTGTAATTACGGTGTCTCGGGCCATTG<br>CCAGCACTCCATCAGGGGCCCCGAAGGTTTACAGTCTCACACAGCTAAGCCTCTGGGGCT<br>CCAGGGAGAAGAGCAGTGTTCCAGGCCTCAGCTGGCGAGGCACCAAACATGGGTGCAGTT<br>GAACCTGCAGTGACCGTGTGCAATTCCCCGGGCCCCGCGGAGAGACGAGTTCACTGCCCT<br>GGGCTTCTCCCCTGCAGGGAGTGGACGACACAAGCTCCTCTGAGGGCAGCACGGTGGACT<br>GCCTAGATCCTGAGGAAATCCTGAGGAAGATCCCTGAGCTGGCAGATGACCTGGAAGAAC<br>CAGATGACTGCTTCACAGAAGGTGAAGGGACAGCCACAGGCCCCCTCACACTGATGTTAA<br>TTAGGGCCAGAATCCAGTTGAGCGAACACTCACCTGGGATCCACAGAAGACAAACAAGCT<br>GTGCCCACTTGCTGCCTCACTCCCAGGCTTGAGGGCGCCCGCATCAGACACACATGCCCC<br>AGGTGGCAGCAGCCTGGCCGTGGTATCTGCATCTCATGCCCTATCAGACACTACGGAGAG<br>ACGTGGGCCTTCCTCTTTACCCTCAAAAACCCCTCCGTGAGTTCTAAACCAGCCCTCTTG<br>AGTTGAAAGGGGAAACGTAGTCACCACCATAAACACCACTGAAAACTCTTGATTTGGAC<br>CATGAAGGACCCAGAGGAAGGCCATGATGTATCTGCTTCCCTCAATCTTTTGTTTAGCTC<br>TCAAAAGCAGAACCTGTGTCTTAGTCATCTTTCCTCTCAGTGTTTAGAACAGTGAGGCAC<br>ATTACATTCTCAATAAATATTTGTGCAATGAATGAATCAAGAGTCCATTCTATAAAGGGA<br>ATTGTGGCCTCAATGCTTTCTAAAAATACAAAGAAAAATTTTTTAAATACTTGAGTTTTT<br>ATTAATAGTTTTATTTGACCCTGGGCTGGGCTGAGCTGGGCTGGACCCAATCCCCATCCC<br>AGCCACGTCGTGGCCCTCAGTTCAGCTTGGGCTTGGAGCATATCCCCCTCAGGCACCCCC<br>AGGCTCATACGCCGTAGCTTGCTGTTTTCCAGGTATAGGTGGGCAGAAGGACAGGGACC<br>ACTGGTGTCATCTGTAAGAAGGATATGGCTAGGAAAAACATCAGAGTGGGCAAGACTGAT<br>GATGGAGAGGAACACCTGTTGGTCTGGATTGGGGACTCCCTGGAAGGGACCCCTCTTCA<br>CCCATATTCCAGGAAAGAATTTTTTTCCAAGGGCATGACAAGTGGGTTTCCTAGCAGAAT<br>GGTTTCTCTGCAGCAGGAGCAGAAATTATCCCCTTTGCCCACTGGCCATCACCCACCATC<br>AGTCACCTCTCCCCACAGGATGCATTCGCCACTGTCCCTGCTGCAAACTGGATACCACCA<br>AGAGTCCATGGGATGTGGGCTGGCAGGTGCGCAAGACTTGCTACCGTATCGTGGAGCACA<br>GCTGGTTTGAGAGCTTCATCATCTTCATGATCCTGCTCAGCAGTGGATCTCTGGTAAGGG |

TABLE 17-continued

SEQUENCES

| SEQ ID NO: Human Allele | Nucleotide/Amino Acid Sequence |
| --- | --- |
| | GAGGCATAGTCCCTGCCCCCAAATCCTCCAGATAGGAATCTCCTACAATCCAAAGGCCCT
GGAGCTGCATCAGTGGGTTCTCCTGACTACTGAGCTGAAAGTCCCCAACCTTGTCACTAG
AAGGAGAGCTGCAGCCCAGGGCGAGGGCCCCTCTTAGCAGCAGAGCATGGGAGGTGTTCA
AGGTGCCCGTGCCATGGCCTGCCAAACCTGGCTGCAAGCATTTGAGTGAGTGAGTGTATG
CCTCCCACTATATAGATGGGGAAACTGACACTCAAAATGTTTAAAAGGCTTGTCCAAGGT
CACCCAACTTGTCAGTAGCAAAACCCAGCTTTGCCCTTATTTAATCCCGAAGCCCCTGGC
TTCCCACCCTCTGACCTCCCCAACACACGGCCTTCTCTGAAGGCCTACAATACAAAAAGG
ACTATCTTTCCTTATCAAACCACTTCCAAATGCTACTAATTACTCCTTTAAAGCTCACAG
AAAATCATTACAATAGCACTTCTCAAAATTTAATCTCCCAGGAGCTTGTTCAAATGCAGA
TTCTCATTCCATAAATCTGTGGCAGGGCCTGAGAATTTGCATTTCTAACAAGCTCCCAGG
TGATGCTTGCACTGCCCTCAGTGACCCACACTTTGAATAACAAGGCCTTATGGGAATAGA
GATTCAGAGTTGGGAGACATCTCTAAGGCCCTGGCTGAATACTGGGCTTTGTAGAGCAAA
GAAGGAAGGTTCTCTCTGTACTGTGGCTTAAGCTCCTTACACAATCTCAACTACTCCGCC
AATAGACCAAGGTAGACATAGACACAGGAAGGAACTTAACATCCTCAGTTGTTTGCATTT
TCTAAATGAGGAAGTCAAAGCCCAAAGGCATGAGGGGCTTCAGGTAATTAGTTGAAGGGC
TGGGAATAGAGAGTTCAGGGTGGCAGCTAATTAGTTGAAGGGCTAGGACTACAGTCCCGC
TCTTCCGATTCACGGCTGCAGTGTTTTCACTCATCTTGCGCCTCATGTGTCATTTACTCT
CTAAAAACAACCTACTAAATATCTAGGCCTCCATCTAAATGCCAGATTGTCCAGGAAGGG
TGACAAAACTGCTCGGTGCATGGCCTCAGCTTTAGGGAGGAGCACAGGTGCGGGACGAGG
CAGGATCTGAGAGGTGGGAGGAAAACTAGGGTGGCAATGACGCAAAGCCAAGGGAGAAGA
GAGTTTCGGGGCAGGGACTGGTCTGCCATCCTGGGTGGAGGGGGAACTGTGTGACAGCGG
CTGCAGGTGCCCAGTGCCCTGGCACAGGGCAGTGATTGTCCACACGGACCTCAGCACAGT
GTAGAGGCCAAATTGCAGGGGCAAGAGAGGGCTGGGCAGTGCTTTCTCCACACCTATGCT
CTTCTCCTTCCAGTCCTGCTGGATTAAAGTAATAACCACATGTGCTGTTGGCCAGGTGCT
CTCCTCACTACGTCATTGGCTTGTGGGCCTTCTCTCCTCATTTTGCTTCTCTGCTCTCCC
TTGCTCCCTCCCTTCTCTCTCTAGCCCCCTTCTCTTCACACCCCGGTCCACCCCCCACAT
TCCCAGGAGGAAGCTCAGACCTGCAGCACTGCGCCAGCCCAGCCCGCCCCCTGCAGCTCT
CCCTTCCCTCCCATCTCCTTCCCCTGGGACTGAACAGGCTGGCACCCAAATTTAGCCTTCT
TTAGGCTTTCACTTTGAGTACCTTTTAAAAATAACATGCATTTTCATCTGACAAAGTAAA
GTACCAAAAAAATACTTGGAAATTATAGAAAAAGGTAAAGAAAAAAAAAATCATCCATTTC
CCTATCACTCAAAGAGAAACTCACTTGAAAACATGCTGGTATACCTCTTTCTCATCTTGC
TTATGCATAAAATATACACATATTACAAAAATAAAACCACATTTATGCATTCTATAACCT
CAGTACATTTTTCTCAGTAAATAGTCTCATATTATCTCATTTAATGGCTATAACATATTC
CTTTATAATTTACTCAACCAATCTCTATGTTTACTTCTAATACACATTGAATATTCCCTG
TGTGTACTCCCTTAGAGACGTTGGATAATCTCCCATCTTAGTCCTCGTCCTAGACACAGA
ATCGGAAGCTGAGAAAAGATGTGGGTTCAGTTGAAATCCGGCTTCAGCTGATCCCATGGA
AAGCCCTGAAGCACAAAGGACACCAAAGAGCTGTCCCACCTTGAGGCAAAGAAGACAGCC
TTGTAAATCCCCCTGTCACTGTCCCTGGCTGAGGGCTGCCCCAGCGGGGAGGATAAGCAT
TTCCCAAGGTGGACACAGTTTCCTCCAGCCCAGCGAAGCCATCAGGAAGGGGTGTCTGC
ATCCATGAACTATTAGCAGCCGACACTCCCAGCAGATGAAGGATAGGGGCACTGGCCCCT
TAAAGAGGACCTGAGTGGGCACCAACAGCCTCCAGTGTCCTTAGGATTAGTGCTTGAAGG
AGGAATTGCTAGGTTCCTGAAACCTCTGAGTCACATTGCCAATTTGGCTTCACACAGGAC
TGGCCAGGTTTTCACTCCTGCCAGTCACTTGTAAGAGTGGCCGGGCGCGGTGGCTCACGC
CTGTAATCCCAGCACTTTGGGAGGCTGAGGCGGGCGGATCATGAGGTCAGGAGATCGAGA
CCATCCCGGCTAAAACGGTGAAACCCCGTCTCTACTAAAAATACAAAAAATTAGCCGGGC
GTAGTGGCGGGCGCCTGTAGTCCCAGCTACTTGGGAGGCTGAGGCAGGAGAATGGCGTGA
ACCTGGGAGGCAGAGCTTGCAGTGAGCCGAGATCCCGCTACTGCACTCCAGCCTGGGCGA
CAGAGCGAGACTCCGTCTCAAAAAAAAAAAAAAAAAAAAAAAAAAAAAAAAAAAAAAAAA
AAAGAGTGGCAGCCCCCCACAGCCACAGCATCCTAGGGTTTCCCCTATTCTTTTCCATCT
CCACCAGTCTGATAAAAGAAAAACAGCATCTTCTTTTAATTTGAATTTCCTTGATTACCA
GTGAGATAGAACATTCTTTTTCAGAGGTGTGTTGGCGATTCTTACTTTCATTTTTGTAAA
CTGCCTGTGAACATCCGTTGATGCTTTTATTTTTAAACAAAGTCACTGTTAGCATCCCTT
TGGTTCACTTCCAAAATCCAATTTGAGAAGGTTTTCTTTCTCCCTTGCATTCAGCATCCC
TGCAAGTATCAGCAGGGCTGTTTGTCCCCATTGGCCCTGAAGAAGTCATGCTTTGGATCT
CACAGTACCTCCTCACTATCCCACTTTACCTCCCCACAGCAAACAAAATGCTACTGGCA
AGCTGACTACCAAATCCCCTTCCAGGGACTGTGGTCAGGGCTGGCTGGGTCCTTCCCTAT
CAGTCTGGGCCCCAGTGCTGTGGGTCCAGGCAGCCTGCCATTCTGCATCCTTTCTTCCTT
CCAGGCCTTTGAAGACTATTACCTGGACCAGAAGCCCACGGTGAAAGCTTTGCTGGAGTA
CACTGACAGGGTCTTCACCTTTATCTTTGTGTTCGAGATGCTGCTTAAGTGGGTGGCCTA
TGGCTTCAAAAAGTACTTCACCAATGCCTGGTGCTGGCTGGACTTCCTCATTGTGAATGT
GAGTGGCTCAGTGGGAACACGTGGGGTTTGGGGTCCTCCCCTCTGACTCCTGGCTACGAC
TAGGGCAAAGGAAGCTCAGAGACCTGGCCCTCAAGGGCTACTCCAAAGAAAAGTTTTGAG
CATTTAGTGAGGAGTCTGAGAATAGCCCTGACACCCATGAGTGGTAAAGTCCAGGCAGTA
TGTGACTGTGACACAATAGTGACTGTTAGGTGAGTTATTAGGTCTCCATTCAGAAAGATC
CCTGCAATCCTCTGCATTTTTACATCCAAAGTGAGATGACACATGCAGCTCTCAGAGGTC
TTATGGCCCTGCATCCATAGATGGGTCTTCTGGACCTTGGGGAGCCATGAACTGTGAGCA
CAGAGAATCTTCCCACCTGCGGTTCTGTGGTCCTCACACCTGGCTGCACTTGAGAATCAC
CTGGGGAGCTATGAAATATGCAGTGACCGACCACCACTACCCCAGAGATTCTGATCTTAT
TGGTCTTGGGTGGTGCCCAGGCACCTGTATTTTATAAATGCTCCCAGGCATTTCCAAGGT
GCAGCCATGGCTTAGAACCACTGAGCTTATACTGCTGCCTCCTCCCCAGTGGCATTGAAA
AGAACAGAGGGCGCATTTGGAGAGGTAATGAGCTGGAGTTCATGTGTTCACACTCATGGT
AACCTGTGGCCAGTAATCCCTGCATTAGAGAATTGACTGTGTGCTTCTCACACATCAGAC
ATGTGATTCCTCAGTCATCTCTTCCTCATCTTAACCACCACATTGCACTATCACTGTCTA
GGCCACTACCTTCTTTGCTTTGCAGCATGGTTAACTGAGTTATCTGTTCACTGCCGCATA |

TABLE 17-continued

SEQUENCES

| SEQ ID NO: | Human Allele | Nucleotide/Amino Acid Sequence |
|---|---|---|
| | | GCTGAGGGTTTCTGCAAGCAGGGTGAGGCATGTGCTGTGTTGGTCTCTGCCTGCCCCACT
CAAGCAGCTGCCAGCAGCAAGGTCTGCCCAGCAGAGGTGTCAGGAAATGTGTCTGTATTT
GGTGCTTGCCTCCTGAAGCTGGATGAGGTTCAGCACAGAACATTCTGTCCAGCCTCCTGT
GCTGGCAGGTCCTCCATAGCAGGCCTGTGCATTCAATTCTCTTCTTCCCTGATGCCAATG
CACTAGCAGCTTCAGGCCACTGTACCACAAGGATTAGCTGTGAGGCCTGAAATCTGAGTC
ATGGGTGATAATTCTGTGCATATGAAATAATTATTCATAAATGAAAGGAAAATTATTTAT
TCCGGTGTCCCACCCCTTTGGGGGCACAGTCACTCCTGCTTATGTTGATCTCACCAGTCT
CAGTCCTAATCACCTTAAACGGTCATGCACTCATTTCATCCATCTTCCTACTGATTCTTC
CTTCCAACCATCCATCCTTCCTTCCATACATTTCACCTTTTGTATCCAACCATTCAGTCT
TCCTTTTTCCTTCCTCCCAAACATCCATCCATCTTTATTTCTTCCAGCTGTACATCTTCA
TCAGTCCTCCCCTTCCATCCATCCATTCCCATTCTTCTTTCCCTCTTCTCTTCTGCCCAA
TCTTTTATTCTAAACTTCCTTCCATCTATTCATCATCCTTAACCCTTATATCTTTCTATC
TTTTGATTCATTCTTCTATCCAACTGTCCAATCATCTAACATTCTGTTCACTCATTCACG
CATCTTCCATCCAAGCATGCTTCTACTCACTCATCCTTCTATCCACTCATTCTTCTATCT
TTCCATTCTTGTTTCAACCTATCCATCTATTCTTCCTTTCTTCCACTTATCTGTTCATTC
ATCCCTTTCCCTTCCATTCATCATCCATTCATCCATCCTATCAACCTTCCAGTCATTCAC
TAATTTATTCCATTCATCTATTCTGTCCAGCTCCCATCTTTCCATTCATGCATTAGTCA
TTTTACCCAGCCATCCATCCTTCTCTTATCCACCTATCTCATCTATCCATTCACTATTCC
CTGCTTTCATACTTTTCCTTTCTTGTTTGTTTCTCCCATCCTTCCATTCAACTATCTATC
CTATCCATCTTTTTGTGTCTGTTATCTTTTAAAATTTTAAAAAATATATTTTATTGTATA
TATTTGTATTAGTCTATTTTCATGCTGCTGATAAAGACATACCTAAGACTGGGCAATTTA
TAAAAGAAAGAGGTTTAATTGGACTTACAGCTTCACATGGCTGGGGAAGCCTTACAATCA
TGGCAAAAGGAAAGGAGGTGCGAGTCACGTCTTATGTGGATGGCAGCAGGCAAAGAGAGA
GGTTGGGCAGGGAAACTCCCCCTTATAATACCGTCACATCTCATGAAACTTATTCACTAT
CATGAGAACAGCATGGGAAAGACCTGCTCCCATGATTCACTTACCTCCCACAGGGTCCCT
CCCCTCCCACAACACATGGGAATTCAAGATAAGATTTGGGTGGGGACACAGCCAAACCAT
ATCAATTTTTAAGGGATACAAAATGATGTTATAAGATATATATATATATAAATGATTACT
ATAGTGGAACATATTAACATATCCATCATCTCACATAGTTACCCATTTCTCCCCCTGTGG
CAAGAGCAGCTATAATTACTCAGCGAGCAAAAATACTGAAAACAATATGCTATTATTAAC
TATAGTATTCATGTTATACATTAAATCTATCCTATTTATCATTGTATCCTTTAATTCATC
CCTCTATGCAATCACCCTTCAACTTTTCATCCAGCTGTACTTCTTTCTTTCTTTCCTTCT
AGCCATCCCAATGATCCTATTTTTCTTCCATTTGCTATACATCTAACTATTGAATACAGG
ATTGTCTTATGAAGTGCTTTGTAAGAAACAGAAGCACAGAATAAATACTCACTATCTCCA
GGATCTTACACTTTAGTCTTTCAGCAGACAAGACACACATGGAAATAAATGTATTATAAG
GGTGAATGTGTTGAGCACTGCTGGGGGCAATTAGTATCTTGGAGACACAGAGACATGAGC
CTTCTTCCACTCTTGGGGTGGGGTGGTTGAGAATTCTTCCTATGGGAGGTGGCATTAGAT
GTGGGGCATAGAAATGAGCAGGACCAAGGAGCTGCGAGAGGACTGGGGAAGGCCCGTCTT
AGCTAAAGGCTGACCTTGAACAAAGGCACAGACACAAGTATGCTCAGGGAACAATTTGAT
TTGGGTAGAATGTGTGGGTGAAATATGACTGGAAAAGTAGGTTGTGACCATATGACACAG
GCTACAGAGTATGGAGTTTATCCTGAGGGTGATAAAGTACCAGTGATGTTTGGGAGTAAG
AGAAAGACATGATCATAATCAGATTTGCAGTGGAGAATAGATGCATGGTGCAGTACTAGG
GCCTGGAGACTACTTGGGAGGCTAGTGGGCTGAGCAGTGGGAATGGAGGTGGGCTTGGGT
GGACAGACTTTGCTGGAGAGGCACAGCACCTGTCTGCCCAGCTGCAGATTATCCATGTG
AGGCAGACTTCCCAGGGGGCTGAGCAAAAGACTGAATAGGGTTCAGCATGGAACTGGCCC
CAAACCTCCCTACCCTCATGCACCCAGGCAGCTGGGTCTCACCTGCTGATGTCTGGAGCC
TTGCATGAATGAAGGAAGAGGGTCCCTTCCATTCCGGTTCTTTGTCCTGGTGCAATAAGC
CACTCATCCAAAGAATGGACATTGCTTGGGGCTCTGCCACTCAAGTATAAAGCCCTTCTT
TTCTGAAGCTCCTGTGTGCATCCCACCTAACTGCCAGGATAAGCTGAGCCTGAATTCAGC
CCACCATCTGTGGTGTGGCTAAGATCTCACAGGACAGGGTCATAGCCCGTATCTATGACA
TCTCCCTGGCACCTTCAAAGTTCCTAGCAGGGGAACTTTTTTCATGTAAGTTTCTGTCCT
TTGCAGTCTTTGGACCACCACTTAAAGAAAACTGACAGACCAAAAGGGGCTCACAAGTCA
GTCATTATATCTCAGATATCTATTGAAGCTAGATCTCATGGACCCATACCAGAAACTTTT
TGAAGAACTGCAGAGCTATCAGAACTTTGGAATTCTCTTAGTCTGACTTTTTCATTTTAC
AAAGGGTGAAAGTACCCTGGACTAGCCAGGCACTAACCCAAGCTCACAAAAAATCAGGGT
TCAAATGGGAATTAGACCCCACCCAAACCACTATTCTTTCCACCCCACTTCTCTGAGCAA
ATATAATTCAGATTACTATATTCCTCAGAATAGACTCTCAGCATAGCCCCTAGGAGGGAA
CATCATGTCTCCAAGTCTCTGAAAATCAGTTTCAAGGTTGTTGAGGCCTGACTGCTGCCC
CTAGAAGGAAAAGGAAGAGTTGATTTAATACACTGGAAGCTTGGCCACCTACGTACCAGA
GGTTGGTGATGTTAGAGACTGAGTTTTTCTTGCCCAGATTGTTTAAGAGAGTGGTGAATA
AAATTTTTAATAAAAGGGAAGAGACAAAACTCTTTCTAGACCTCTCATTGGAGTTCCGAA
TAAGGTGGGAGCTAGGATGATGGCTTAGACGTGTAGGAATGGGAGGCTGGGCAGGGAGTT
CCTGTCTCCTTCCACGAGGACTGCCTTTCTGGAAACCTAGAGTGATGTTTCTGCCCTCTC
CTGCACTCAGATCTCACTGATAAGTCTCACAGCGAAGATTCTGGAATATTCTGAAGTGGC
TCCCATCAAAGCCCTTCGAACCCTTCGCGCTCTGCGGCCACTGCGGGCTCTTTCTCGATT
TGAAGGCATGCGGGTAAGTCTGATCTCAAAACTTCTCTCATCTGGCCAGGCACGGTGGTT
CATGCCTGTAATCCCAGCACTTTGGGAGGCTGAGGCGGGCGGATCACCTGAGGTTAGGAG
TTCAAAACCACCCTGGCCAACATGCCGAAACCCTGTCTCTGCTAAAAGTACAAAAATCAC
TACCACCACGAGGTGTGGTGGTAGTGAGCCGAGATTGTGCCATTATACTCCAGCCTGGGT
GACAGAGCGAGACTCCGCCTCAAAAAACAAACAAAAAACTTCTCTGGTCTGCAGGTTTTG
GTAACCCTTCCCCCTTTATGCCCTCCATCCCACCAACCCTGAGCTCCGGGGCCCACCTC
CAAAGGTAGGCTCTGAGTCTTCACTTCCTGCTCTGACTTTGGTGGTGCTGCATGTCCTAA
CTCTCTTAGTTCTCTTTCAAGTCTTTTTGTGGGCCCATCTTCCCTTGTCACCCATAAATA
TTACAGCCACCAGGACCCAGACCTCACCCCCTTTGCTCTTAGTGAAGTAATCCTGAATCA
TCGCTCCACAAGCATCTATTATCTCAATCACCCAACTCTGCCTCTTATTGCCAACATCTC |

TABLE 17-continued

SEQUENCES

| SEQ ID NO: Human Allele | Nucleotide/Amino Acid Sequence |
|---|---|
| | CAGAACATCCCAAGTTCTCTGTCTTTCCATGACAAATGAGTCTTTCCTCTAATACTCCAT
GAGTGACATCATCAGCTCATTACCTCAGCTGCCACCCACTGGAATGCTTCTTCTCTCCTA
CTTAATGCAATCATCAGGTCCTGTAAATTTTTCCCTTCCATCCACCCCTTTCCTTATCCA
CCACTGTCAGCCTCCACCTTGCCCTAACTGCCTCCGTCAGGACAGAATGCTCACAGCCAG
AGCCTTGTCTTAGAGATTGCTGATTGACACCCACCTCTTCCTCATAATTACAAATGGCTC
CCCAGCAGAAAGTAAGGTTTTGCTTTGCTCCACTATCATTGGCTGGAAGTAGTCATCATA
GCTTCAAAAACAAAAGTGGGCTTTTGAAATTAACTTGTACCTTTACAAACACTAGGACCC
GAAGATTGAAATAGTTTGAAATTTATTCTATTTTGTATCTAATAGATTCTCATTTGCTTA
TTTACAAATAAGCTATTTTGTGAATATGGATTTAGGTTTTCACTGGTTCTTGACCACGGC
ATACTTTAAATTGTATTTAAATTGTGTTTGTGTTTTATGTATGGTATTTAAGGAGAATAA
GTCAAGGTTCTAGAAGTCTGTATGTGCAAGTATAATACACACACTCACACTTCTAAATGA
GTGCAGTATGCTTGTAAACTCATCCATCTTCTCACTGCAACCCACCCTGAATGAGGTTAA
GGGAAGAAGGTCTAAATCCATCTTCAGCTGCCCAATGTCTCTCAGTCTTCTGAGTCTGAA
TTATTGCACTAATTAACCCACTTCTCTTGCTTCTTCCAAAGGCCACTGGCTCATGAAGCA
GCCTGAATGAGTATAGAAAGAGATAGAATCCAGCAGAGGGGGTGGGCATTGGGAGGTTC
CAGGTCTTTCTCTATCTCCCACCAGGTGGTGGTGGATGCCCTGGTGGGCGCCATCCCATC
CATCATGAATGTCCTCCTCGTCTGCCTCATCTTCTGGCTCATCTTCAGCATCATGGGTGT
GAACCTCTTCGCAGGGAAGTTTTGGAGGTGCATCAACTATACCGATGGAGAGTTTTCCCT
TGTACCTTTGTCGATTGTGAATAACAAGTCTGACTGCAAGATTCAAAACTCCACTGGCAG
CTTCTTCTGGGTCAATGTGAAAGTCAACTTTGATAATGTTGCAATGGGTTACCTTGCACT
TCTGCAGGTGGTGAGTCAACCATGAGATCAACCATATCTCTTGCTTTGGCCGCTCAATAA
AATGGAGAGTCTAGGTTCCCAGAAGATGCTATGTGGGACTTTGCAAGGAGTAGCACTCA
GTGTGAACTGAGGTCATTCTCTATTCCTACAGACTACACCATGAGGCTAGAGGGCCTTCC
TAGTGAAATATGATATCACAGTGGTGCAATTACACAAGTGTGGGCTAGTAGAATAGCATAA
AGGGATGGGCCTGCCATGGGATTATCAGGTGGTGAGTTAAAACACAGAACCTGTACAAAA
TAGACACGGCATAGCCACATGTTCAGTCTTCAACTTCACATCATTTCCTAAATGGTAATA
AATTATGTCTCATTAGGTCTATTGTAATGATATATAATGTTGGTGATAATGACAGTCAAA
CACATTCATCCTGTCTTTCTTTCTTTCATCATCCAGTCAATCACTCATTTCTTGCCTTCA
TCTACCTGTTCATTCAGTCCTCTGTTCATTCAAGTGTTAATACAATTACTTATACATTTG
TCATGCAGTTACTCTTGAGTGTCTACATTCCACCATTGGTTCTTGCATTTATTCAACAAA
TAATCTCTGAGTAGCTCTGGTATGCCAGGCATGGTACTACTCAGCCCTGGGAGATACAGT
CAGAACTGGGCTTGGACACTGATGCTGTATGAGAAACAGACTAATAGGTGAATTAAAACA
GCTCATTAAGTGCTGTAACAGGCCTAGGAGTGTAAGAACTAAGATGTCTTGCATGCTCTG
AACATGCTGGAAGGCACACCCAGTTTCTAGACCTCAAGAATGCTAAAGCTGAAGGCAGGA
ACATGGAGGTCTTCTATTCTCAACTTCTCCATCTGGAAGATATACCATTCTTACATCATG
TGCATAAGGTGGGAAAGTGGCTGAGAAAATGGCAGCCCTGAGAGGGGAAACCTTAGGCAA
GTGCACAGAGCAGACTTGTAGCAATTGGCACTAGAACCAGACACCTAGACACTCAGTCCT
CAGTCCATACTACATTCTGAAAGGCTCTGTGTCTTTAATGCTACTCTATTCTTAAACAGC
CACATGTGGGATTACTTTAAATCATCATATGAGATTAGTCAAGTAACCCAAGGGAACTTT
TCCTTTCATTCTTTCTGCACAAGCCCTTTCCAACACAGGACTCTCTCCTCTCTCACTGGG
CCACCATGGCTTGGGAAGGGTCCAGTATAGATGGATGGGCAGACACTGAGTGGCCTCTGC
TCCTTGTCTCCAGGCAACCTTTAAAGGCTGGATGGACATTATGTATGCAGCTGTTGATTC
CCGGGAGGTGAGTCTCAGCCCACTGTCCCTACAGCCTTCCCCTCTGTGCATTCTACCCAT
ATCAGTCTGCATTTGAAATGAAGTGACGATGACCCTGGTACTGGAAGAGGCGATCACCCA
GCAACCTCACACTGTCCCTCCTTGCAGCAGTGTCCAGCTGGCTCTCTGTTGAGTGTTTCA
GCCACCGAGGCTTTCCCCCTTTCATCTACACTCCCCAGGCTTCTCGAGGTTTTCCTCTGT
TCACTGTTGAGGAAAGCATCAGATAACCTCTAAGAGACAGTTCATGTGAGCCACTCCCTG
GACAAGGGTGGGAGCAAAGCAAGGGTAGTAGCTAAATCAAGGTGCATAGGGAGGAATGAG
GTAGAATCTCAGGAACTATCATAAAACCCAGGATGGGCCAGGCGCAGTGGTTCATGCCTG
TAATCCTAGCACTTTGGGAGGCCGAGGTGGGCAGATTGCCTGAGCTCAGGAGACCAGCCT
GGGCAATACGGTGAAACCCCATCTCTACTAAAATATGAAAGAAATTAGCAGGGCATGGCG
GCTTGTGCCTGTAGTCCCAGCTGCTCGGGAGACTGAGACAGGAGAATCTCTTGAACCCGG
GAGGCAGAAGTTGCAGTGAGCTGAGATTGCGTCACTGCACTCCAGCTTGGGCGAGACAGC
GAGACTCAATCTCAAAAAAAAGAAAAGAAAAGAAAAAGCCAGGCTGGGAGACACTATT
GGGGAATGACCACTTCCTGCTGTGGCAGGCACTGTCAATTCCCTGCCACCTCTTCCCTTA
GCCCACTTCTGATTTCACCTGCAGGCTGCACTTCTGATTCTCTGTATAAAGACTCCAGGG
CTTAGGAGCTTGTGCAGCAACTTCTCCCCCAAGTACCAGGGATTTAATGTCCCTAGGGGC
AACCCTTACCAATAAGTTTTGGGAGTCTGAGGATAAATACTCCAGTTTCCCTGTCCCTTG
GTGATATAATCCTGCATGTGCTCTACACAGTTACTCAGAGGACCCCAGTAGGATTGCGCT
TCAGTTGCCCACAATGATGCCCTGCTTAACAACATCCTCTTCACAGGCTCTTCTCCCATT
CCCGCTTATTCTTCCCCACTCCCTCATTCCTGCTTCCTTGGATCACCTCCCAGATAAATC
ACCTGCACCCAGGTCCATGTCTTAGGCTTGGCTTTCAGAGTGAACCTGAACTAAGACACC
CACCCTCCTTCCCACTCTCCCTTGTCTGGTCACAGGTCAACATGCAACCCAAGTGGGAGG
ACAACGTGTACATGTATTTGTACTTTGTCATCTTCATCATTTTTGGAGGCTTCTTCACAC
TGAATCTCTTTGTTGGGGTCATAATTGACAACTTCAATCAACAGAAAAAAAAGATAAGTG
GTGCTCAGGAGTTTCTGGTTTCTGCTGTAGTGGTAAGCCTTATATTTCCTGTTCCCTGCC
CAGCTCTGGCCTCCTGACAAAAGCCAACACTACTCACAGCCCATCACTTTAATATCAGTG
CTAACCCTTGCCCTGTGATTGCTGTTGCAGGAAGAGTTGCATTTCTCTCTGTCAGCAATG
CCCCACTAACATCCTCACTCAGGATTCACATCTCAAAGGGATCTTGGTCTTCCCAACTGG
AACCAGGTGTGTTAGATGTGTTCCAAGTGAGCCCTGGGAGAATACAAGCAGGGAAAGAAA
GGGATCTAGAACTTGCTGACCTGTTGGGGGATATGATCCCCACAAAGGACTGAGTCAGGG
CACCTCAGGAAAGGCCATGGCCCAGCACTGGCAGAATCCCAACCCTCCTTGGGATGGGGA
GGAAGGCTTGTGCCTCCAAGGGTGCCGACTCTGATTAATAGGAATCGAATCCCAGATAAC
CTCTCATGTTTATAAGAAAATGTCAGGGCAATAAAGGTATAAAGTATTTTCCTATTATCC |

TABLE 17-continued

SEQUENCES

| SEQ ID NO: Human Allele | Nucleotide/Amino Acid Sequence |
|---|---|
| | TTTCATTTAATGCCTTCCATACCCCTGAGGTAGATAGGCGCTGTTCTAGATTTGCGTAAC
TGAGATCCCGAGAGAAAAGGGGCTACATGGATAAGTCACAGAGTACATGCAAACCTGGGT
TTGCATTCCTGACTCAACTACTTGTGGATGGCTCATGCTGGCAATATTTTAAACCCCTCT
GAGTCTCAGTTTTCTCATTCATTCAATGGGGCTAATAATACCTACTCTCTGGATTGTGGT
GAGGGGTAAACAAAATCCTGAACAAAGATCACTGAGCATAAGACAACTTTGGTGGTGCAG
TTTCTGGCACTGTAACAGCAGAGGGGAGTGTGACTGGCAGCGCCTCAAGAGCACCAGATG
CTGTTGCTATTAACAATTTAAAATATATACCTACTAGGGCAGGCATTCCACTTACAGGAA
ATCCTTGCCCAGGGTTCTGAGCATAAGAAGAGGACAGGATAGGTCTGGGACAAGACAGTG
CTATTTAGTACCCTGGGGAGGTTTGAGATTATTGAAGCAATCATTTCTCTCATTTTACAG
ATGAGAAAACTGAGGTCAAGAAACAGATTACAGAGGGAGATATTAGGTAACGGAAGGAGA
TGAGCTAGTGACCAGGCTGGGGTCACTGAGAAACTGCATCTACTGAATCCTTGGTCAGAG
TTCTCAGCATGACCTCACCTGGAGCTCACCTACCCACTGCCCTTGCCCTTTCCTTCTCTC
CCCCCATAAAGATGGTCCTCCCAGGAAGCCCTTTGTGTCCACAGATCTTCTCAGATCTCC
TTTCAAATTCCACAGATCTCAGCCCAGTTTCCCAGCATTTGCAGGGACTAACTTACATAA
ACATGTTATTAAATAGGTGGCTTTCAAATTATGTCAGGAAGCTAAAGGTGAGAGTTTGA
ATGAAGAAAATCCAAAGGGCCCCTAAAGAAAAACTAATACCCAATCCTAAGGGAGGAAAA
CATCTTCGTTGGTGCAGTTTCTGGCACTGTAACAGCAGAGGGCAGTGTGACTGGCAGGGC
CTCAAGAGAACCAGAGGTCCCTCTGAGACCAAGGACCCAAGGATAAGGCAGTAATTGTCC
TCATCTCCTCCTCTCCAGAAAAGATTTGAGGGCTTCTGTCCCTCCCAGAGTCTTTGCTTC
AAGGTCCTCAGGAAATCTCTTGCCCCCTGGGAGGGACTGTGACTCTAGAAGCCCAAAGAA
TTTTACTGGAATGAACAGGCTAGATCCAAGGCTCAGATTTGAACCAACATGTACCTTCTC
CTTGAGTCCTGTTTACCAACCCTCCCCACCCTTTATCCAGCATCTCTGGATCCCTGGAGA
ACAGAAACTGGCTTTGCTTTAGAGACCCAGGCAGGGAGTCAGCAATGGAACTCAGTCCCA
CCGTTCCGACACTGGATGTGGCAAGACACTCCTTGATGCTGGGCTTGGTTTGTCTATCTG
CAGAGGAGGGGAGAAGGTTGATATGATCCTTTCTCTCCTGCCTGTTCTGATTTTGGTATC
CGTAGGGGGTTCCTCTTGCTTTAGTAACAGTGTGGCCCTCTCTGCACTTAGGGGGCCAGG
ACATCTTCATGACAGAGGAGCAGAAGAAATACTACAATGCCATGAAGAAGTTGGGCTCCA
AGAAGCCCCAGAAGCCCATCCCACGGCCCCTGGTGAGCCCCAGAGGTTTCCTCTAGCACA
GCCTGTCTGTAATCCAACATGACAGTCTATGCCTGTGTCAGGCAGGGGCCTGAGGGAGT
GCTGTTTATGGAAGAGAAGATCTGGGTTGACGTTGGGATGAGGGTGATGAGGGTTCCTAG
GCCCAAGGAATGAGAAGTTCAAAAGAAGCAACTCTGGTCTTCTGGAGTAAACATACCTTT
TACAGCTATTTGAAATGAATCTGTTGGGGGAAGCACTGAGTTTCTCCAACAGTTTTAGAG
TTCAAGTACAGGATTGGAGGCAGGTTAAGCTAAGTGACAGTAAGGGTAGTTAGAACCCAG
GGATTAAACTTGTGTGGTTATGTATCATGGTCTAGGTCGCAGTAGATCTCCAGTATCACC
CTATATTCTACCCCACGCCTACAGGTATAGAGAGGAAATGACAACAACCCAACTCCCCTG
TCAGGATCCAAGATGCAGTCATGGTAGTGGTCAAGTGGCCCAGTAGGAACCAAAAGTTAT
CCCACTCGAGTTTAAAGATTGGGCAAAAATTAGGGCCAGACTCTAGTTTCACTCCTTTTT
TCATAAAGATCTCAAGAGACATGGCTTTGCGTTCCTCCATTAAATGTACTACCCATACCA
CACATGGATATCACCTAAGTTCTTCTCAGTCTTCTGCCAGAAGATAGAAAACATCAAGCCT
CTGAGAGGCCCTAAGATAGCACTTTTTTGGGAATGGATGAACAGGTTTGGGGGTGAAGAT
GTTGATGTGTCAGAAATTATTGTTGATCGTCTTCAAAGAATTTCTGAGCCATCCACTCCA
GTGAATGGAATTGGCCCTGTGTCCTTCTACATAAACTTTCTGTGGCTAAGATGCAGCATT
AGTGAAGAAAATCACAGGTATTGCTGATGACACAATTTCATTAGCCCTTCCCCACACAAG
GGAAAAGTCCAAAGGACATTTAACAAAGGAACAAGCCTTTCCCTAAATGAATTATGGAGA
CATGCATTCTGTTAGCCAAGCTATTAGATTTTTTTAAATCAAGGTATAGGATTTGCATAA
TTTACTTCAAACTTTGTCAGAACAAAGTGAAAAACATTTACAAGAGAAAAAAGTGATGAC
TTTTGACACTGTATTTTGAAATAGTGGTCATGAATTTATTACTAGTCTAGATTCTGATAA
GAAGTATTACAATGGGGAGTGGGGAGTGATAGGAGGTTCAGACCTCTGTAGGGGCACAGC
TTTCTTCCTAAATCACCCATACAATCAAGATAACTGGATTTGAGTGAACCTGAGCAAAAG
TCCTTAGGCTCATTGAGTATCCCTCCATCAACAAGTTCAGTGGAGAGGAGCAGGCTCAAA
ATTAAAATTAGGTGAAAGGCTGAGTCCCAACCACATTCAAGTCATGGGTAATGAGAGGAG
GACCCTAAGACTTACTGAGAAGCAAGCAGCTGAGTCCACACTGGCCTTTACTTGTGGCTG
GAGTAAGATTGAATCCACATTTGAGCCAGATGCCAAGGAGGTGTGTGCTAGGGACAACCC
TTGGCAAAAACATGAAAGTTTTTGGCACCTTCCCCCACATACTACTCAATCTCTCTTTGA
CATCCCAGCTTCTTCCCTGTCATCACCCAACCCCATAGGCTGCCAAAGAAAGCTTCCTCC
CCTCAAGGAAGACAACATTCTTAGGACAAGATAAATCATATTTCAAAAAGGGACCCTGGA
GAGGGCATCTACCTACAAAGGCATGACCCTAATGTTGAAATTCCAGGCAGTAAATAGGAG
TGGGAGACGGAGTTGATGGTCAGGCAGGAAGACCTGCAACAAAATCACCATTTCTCCTAA
TTAAGCTGCAACTAAGATCCTCCGAGGATGCACAGGGGGAGACCTCCACATGTGGAGGG
GAAGTGAAACCTCATAACCAATTCTGTTCCTGAGATTCTCCATCCTTTGAATGGAAGAAG
AGTGGATTAGTAATTCACTCTCAACCTTTTGCTAGCCTTAGTGGAGGAACGTGGCTCTCC
CCTTAATATTCTGGCCCAAGCAAGGTAAACACTCTTTCCTTTGTTCCCTAATTTCGCATA
GCTGAGGCAAGGCTAGAACATTTAAACAAAACTTTGAAGTGGCAGGGATGCCAACAGAGA
AATCAGCACAAAGCAGAGTCCAAGCAGCACCTGCAGATGGCTGCACTCCAGGACCCATAG
GTCTTGGACCATCCTAGCTCCTGACCAGCATCCAAATGGCAGGCAACATCTTTGACACCC
ACATGCCCAGTGGCACAAGCCGGATCATCTTCCCTCTTCAAAGTCTAGAACCAAGAAAGA
AATCCAAGGCAAAGGAAATTCCCACTCCCAACTAAGACCCTTCTTCCCAGGCCCAGCTT
GCTTTTGGCCAGATTATTGGCCCTGGAATGTCCACCTTCTCCCCTTAGGAGCCCCAAAGG
TCAAGCTGGTCATACCAGCAAAGCACTGACACAGGATTTCTGCCCCATCAGTGCATGGGT
GCCATTTCATGACAGAGCTTACCTGGGACCACATAGGAGCCTCACACACCTCCTCTCACC
TCTGATGATGCTCAGGCTCTAAATCTTGTTTCTTCCATAGGAAAGTTAAGGATTCCACA
AGACTGGGAATTTTATTCTTTAACATTCCCTGCTACAGAAATCAATAAAAGCAGCTCTC
ACATACTCCACTTTATAGAAATATAATAGGCTCTAGAGAATATCACATAATCAATCACCC
ACTTCATCGTCTCTGAGAGCACCAAGGGTTGCAAAGGTATGATCCCTGACCGTGGGCTAA |

TABLE 17-continued

SEQUENCES

| SEQ ID NO: Human Allele | Nucleotide/Amino Acid Sequence |
|---|---|
| | TCCAAGAGCAGCTAGCAAGCTACTCCATTCCCTAAAGTCAGAATATCCAGGGCAAACTTC<br>ACACCCAGCCACTTAACGATGCCGTTGCCTGCTCTGTTTAATTAGAAGTCATGTGACCAT<br>GAATGGGCCTGTATTTTTCACCATTTTCAGTGATGAAATGGAAGGGATTAGTGGCTCAG<br>CAATCCCCCTCCTGCCCCAGGAAAGATGTGAGCCAGCAGTTCTGCCATGAGCAAAGGCCA<br>CTTTGGTCTGATTCTTTGCTCTAACCCAACAGGATAGCAACCCATCCCCACCATGAAGCA<br>GAAGGCAAGGATCAGCCTCATCACAGCACTTCCCCCTCTGCTTGCTGTGCAGCTCCCGTG<br>GGCTCCCTGGAAGGGATCAGACAGGTTCTTCTCTTCCTCCCTCATAGCCACTCATGCAGA<br>GGCTTGCACATCCCATACATTCAGTATGTACCCTTGGTACAGAATTGAATTTAGTCAAAT<br>AAAGGGTGACTTTAAATTTTCATTTGAGCTATGGTTAACTCAGAGCTGCCCATTCTGTCT<br>TCCATTCATTTACAAATTTGCAGAGCATCTGTTGCAGCCAGGCACTATGCAGACACCAGG<br>GTTAGAGCAGTGAGCAAGACAGACAAAGTTCCTACTCTTACAGTTTACAGTCCAGTGACA<br>GAGGCAAACAGTTGGCCAAAAGTTGCACATATATGTTAATTCCTGGCTGGATAAATTGTC<br>AAGGGAGAAAAATGGGGTGAAGAGCAAAGGATGCTCAAGACTGAGCCTCGAAGAACTCT<br>GATGTCTAAAAGTTGGGTAAAGGAGACTATAAAGAGCATCACAAATGGCAAGAAAAGAA<br>GCAGAAATGTAAGGCATGGTGGAGACCAAGAAAGCAACATTTCAAGGTAGAAGGGTACTA<br>GGCAATATCAGACAAGCGTCCTTGGATCTAATATTATGGGAAGTCATTCATGATCTTAGT<br>GAGAACAATCTCTGTCAGGATAGAGGCAAAAGCTCTGTTGATGTGGGCTGAGGAGTGAAT<br>GAGGGACACTGATTGTACACAACTCTTTCAAGAAATTTTGCTTTGAAGGTGGGAAGAGAT<br>CTAAGATGGTAGCTGGAGGGAGATGTAAGTTTCTGAAATATTCTGCTTTAAGTTAGGAGA<br>AACTAGGTCATTAGAGATTTGTGCAATAAACCAAGAGACAAAGAGTAATGCACATGGACA<br>TTAATGTTGCCTAGGATAATAGCCAAGAGTGGGCAAATATGGCCAAGAGCCTCACCCATC<br>ATTACTGAGGCAGAGGGACCAAGAGTTTGGCAAGCGGCAGTAATGAAGAAGTGACAAAAC<br>TAGGTGGCAAAGCTTCAAAGCAAGAAGGGGTTTTACAAGACACAGGAAGAGCAGTGGTGT<br>GGAAGGGTCAGTGGTGAACAAGGAGAACGCCAGGCCTAACCCCTGAGGTACATGGGGTAG<br>GGGAGAATGGCAGCCTTTGAATAGGGGGAGATATGTGCAGATCAAGGCAGGTGAGCTCCA<br>TAGAGGTCAGGAGAAGTTTTGGGAGAAGGTCAAAGCGTGGGGAATGGGGTTGGGATCAAG<br>GACTCACAGAGCAGTAAGATGTTCACAGCACTAAAAGAAGAGAAGATCACAGTAGGAGCT<br>TTTTAAAGACACCATAAAAATAACCAGATATAAATGATCTCTTGGTTATCCAGGCCACTC<br>TGCCTCCTTCCAAGATGCAAACAACCAAGACTTGACCCTACGCCCTATACCTGCATTTGC<br>TTAGGCATTTGCACAGCACCAGGAACAGAGGGAACATTTCCAAGAATAAGTTTCCCCTTT<br>GCACTTGACTTTACTCTCAGCAAAGTAGCTCAAATTAATATTTCAAGCAGCTCTTGAACT<br>CTTGCAATGTGCAGGGCACTGCAGGGAAACAAAGTTAAGGAAGGTATAGCCCTTGTCCTC<br>AAACAGCTCATTGTCTAGTAGAGAAGACGCATATACAAAATGCTAGAACTCGAGGCTGAC<br>TGAAAAGTGGGATCCCCAAAGGGACAGGGTAGTGTGTTGTCACGTGACTAAGGGACACTC<br>CATGCAGTAAGTGGAGCTTAAAAGAGATGGATTACTCAAGACTGTTGGAATTTAGACAGC<br>CAAGAGAGGAGATAGGAGGGCATTGTGAATAGAGGCAAGGGCACAGACCAGGACAAAGA<br>AGGGCCTGGTGGCATCAAAGGGCCAGGAGAGGTATTAAGGACTTGAACTGGGGCAATGAG<br>GTAGAGTCAACTAAAAGTGAAATTTTGGAAGAGGTAAGGATAGTATTTCGCTTCTGTTAA<br>GATGTGGAGTGTGATGGAGACAAAACTCATCTACAGATAACACAGATGCCTGGTTTGTGC<br>TGGCCCAAAGGCCCTGATGCCACTATCTCTTGTTTTCTCAGAACAAGTTCCAGGGTTTTG<br>TCTTTGACATCGTGACCAGACAAGCTTTTGACATCACCATCATGGTCCTCATCTGCCTCA<br>ACATGATCACCATGATGGTGGAGACTGATGACCAAAGTGAAGAAAAGACGAAAATTCTGG<br>GCAAAATCAACCAGTTCTTTGTGGCCGTCTTCACAGGCGAATGTGTCATGAAGATGTTCG<br>CTTTGAGGCAGTACTACTTCACAAATGGCTGGAATGTGTTTGACTTCATTGTGGTGGTTC<br>TCTCCATTGCGAGTAAGTGGGCAGCCACGTGGTGGGGAAGCCCCACCTCTGTTTGGGGGT<br>CTTTGGGATGCTCTTCTAAAACCAAGGAAATAACCAACCAACTTTTTGAAATACGTGTTT<br>ATGTTAGAAGAACCCTGTATTTGCAGCTTTCCAAGAGTAGCAAGTTTTAAATGCCTTGGG<br>CTGCTCTCTCAGTGAAATGAAGAGGTTCTCTTGGCCTTCTCCATGCTCACACGAAGTGTT<br>TTCAGGCACCTACTGTGTGCACAGCCCATGGCTAGAACCTCAGGGGCTGACAGGGAATAA<br>TCACTCCTCCTGAGAACCTCAGACCGTAAGATGATGGAGTCTCCAGCAGACCTTACTTTT<br>ATGGTCTTGAAAGCAGGGGGCAGGTGGTGTAATGTGAGATGAGTCTTAAAATCTGTTCTG<br>GAAAAGGAGATGGATTGCCATCAAAGTGAGGAAAGACTGGGAGGAGATTGTTCAAAGGAG<br>ATTCTCAAGTCTAGGGTCTGGAATTAAATCTCTACACAACTGTTCTATTAGGGAACATGA<br>GTGATAGAAAAGTCAAGATATCAATGCCAAGAAATTAATACTGTTAAGGCCCAGTCTGGG<br>TGTTGTTGAATGACAGGCCCAGTATTTTGGGTCCAGTGGTGTTCAGAGAAAATTACTAGA<br>GTTAGAGGCTAACATGGGAAATGGAGCTGCCTTGACTGAATACTTCCTAAGTTCTGAGC<br>ACTGAGCTGGGCTCCATGAATGTTCACAGCAGCCCTGTCAAGCAGGTGTTATTATCCTTA<br>TTTTATACATTTAAAATTGAGACTCAGAGATCAAGAATATTATGCAGGGTCACAGAGTTT<br>CCAAGGGTTGAAGCTGAGTTTAGAACAGGCTCCAATCTTCTAATGAACTTGCTGCCTGTC<br>ACCAACAGCCAAGAGACTGTCCCTGGGCTTATGGGTTAGCTGAAGTTTGACCCTATAAAG<br>GCCAAATCATGCTCACCAGCTTCACCTGGCATTATAAATGTATCTTGATTGGTTATATCC<br>TGACCTGCTTACTTTTCATGTCGGGGTGTAGCTGTAGATTTAATTTGCCACTGATTTAGT<br>AACAAGAGCTGAGAGTATCTAAATACAACTTAACAGCATTTCATCAACCTCCCCACCTTG<br>GTGCTGAAACACAGCCTTGGGTTGCGTGTATTTCCGGGGATTTCAGTTTGTTTTTGTTCT<br>TGTTTTATTTTGATATTGCTGCTCTGTTTTTTAACACTTTATTGAGGTATGATCCACATG<br>TAAAAAGCTATACATGTTTAATGTACACAACTTTATGAGTTTGGAGATAAGTATACACCC<br>ATGAAACCATCACCACCATCAATGCCAGAAACATGTCCATAACCTCCAAATATTTCCTCC<br>TGCCTATTTATTTATTTATTGGGTGCTAGGAACACTTAAGATTTATTCTCTTGGCAAATT<br>TTTAGGTAGACAACACGGTATTGCTAACTATAGGGACTATGCTATAAGTAGAGCTCTAGG<br>ATTTATTCATGTCACATAACTGGAAGTTTGTACACTTTGACAAGTACCTCCCCAATTTCC<br>CCTCCTCCCAGCTCCTGGAAACCACCATTCTATTCTCTGCTCCCATGAGTTTGACTATTT<br>TAGATTCCTTATATAAATGCAATCATGTCGTTTTTGTCCTTCTGTGTCTGGCTTATCTCA<br>CTTAGCATAATAGGAGTTTTTGTTGGTTGGTTGGTTAGTTGTTTTCATTTTTGTTTTGTT<br>TTGTTTGTCTTCCAAAATGAAAGATTCCAAAGGCTATTTTGATTTTATATTAAAGAAGGG |

TABLE 17-continued

SEQUENCES

| SEQ ID NO: Human Allele | Nucleotide/Amino Acid Sequence |
|---|---|
| | AGCTTGTTTGTGTATCAGTAATATAGAAATAAAACATAGCCAAGTACTTAGTTCTATGAT
GGGGATATCTTAACTACCAGTTCCTGTGGCTTACAGGGTAGCACCATCCGCTGGGGCAGG
AATCCCTTATAGAGCTGGAAAATAAGCAGAAAAAACCCACATATCAATCTTTCTACCCTC
TCTCCTTACCTCCCTTTCTTCTTTCCCACCAACAAGAGGTGATTGAGTATCTAATTGTTA
CAAGTACGAGGAACCATTCTCCCTTAAAATAAGATCCTGGAGCAAATTAAAATGTGCTGT
AGACCAGTTGTCTGGCAGAAAATTTTACCAGAGTATGTAGACAAATAATGTACCCTACAC
GATGGGAACATGTCCTAGTTAAACTGGAAATTCACAGAAGGTCTTCCACAAAGATTTTAT
AATCCAAAATTATAATTATTTCCCAAGTCCCCTTCTACTTTCTTCCTCTTTCCAACACAA
TATTGTGACCCATGTGCATAACAACAAAGAGCAAGTAGGGGAGAGGGCCCAGGGAACCTG
GCAAGGAGCGAGAGCTTGCTGCTACATCCCTCACCATTTTTCCTGTGAGATGTTGAACCC
TCTCTTACCTAAAGGCCTTGCCTCATCTTTGGTGGAGGCCTTTGGTACAAATAAGGCTCC
CCAGGTCCCCAAGACCAAAAATCAAACATCTTCAAGTTAGACATCATATAGAGGGACATA
TACATTCTTTATATTTCCAACTTTGTTCATAGTTGGAGTTGGGGGCAGTAACTGACTCCC
CCAAAAAACCTATCTCCAGGCCCTAACATAAAGTTCAAAAACAGCTGGAACCGAAAAAA
AAAAAAAAAAACAAATTAAGGCATTGTGCAGACAGCTGGTCATTCAAATCCCTTATGCT
TTAGCTGTCAGCCAGTTGCCCGAATCCTCAGGCCCCCTTGTAATTAACACCAGGCTCCGT
ACAATTAGCCACAGGACCGGGTGCCAGAAACAGAGTCAATCTTCACAGTAGGAGGTAGGG
AGAGGAATCATAAGGGGTCCTGGCCTTCACAGAGCACAGGACCAGGGTGGAGGAAAGGGC
ATGACCCAAAGGCTGCAGTATCAGGGAGGAGCAGGGTCTGTGTCATAGGAAAAAACAGGC
CAAAGACTGTGAGCCTGTGGAATAAACTGCAGTCACTTCCAGCTGAACTTGGCTGCAGAA
GATAAGTTTTTGACTGTGGAGGTTGACCAAGAGGATATTCTAGGCGGAGGCAAAGATAAC
ATGGTAGGAAGGGTAAGACGGAGGAGGAAGAGAGGACTTATGCAATGGGCATTTACTGAG
CCCCTACTTTGTGCTACCTACCATGCCAGGCTCTGAGGGCCCAGAGTCCTCAAATGTGGA
TGCCCAAGTGGCAGTCTATACCAAGCAAAGCAGAGTGTCATCACAGCCAACTTTGTCACG
TCTCATGGCTGGAGATACTAATTAGATAATTTCTTCCTTCTTTTAAAGGCCTGATTTTTT
CTGCAATTCTTAAGTCACTTCAAAGTTACTTCTCCCCAACGCTCTTCAGAGTCATCCGCC
TGGCCCGAATTGGCCGCATCCTCAGACTGATCCGAGCGGCCAAGGGGATCCGCACACTGC
TCTTTGCCCTCATGATGTCCCTGCCTGCCCTCTTCAACATCGGGCTGTTGCTATTCCTTG
TCATGTTCATCTACTCTATCTTCGGTATGTCCAGCTTTCCCCATGTGAGGTGGGAGGCTG
GCATCGACGACATGTTCAACTTCCAGACCTTCGCCAACAGCATGCTGTGCCTCTTCCAGA
TTACCACGTCGGCCGGCTGGGATGGCCTCCTCAGCCCCATCCTCAACACAGGGCCCCCCT
ACTGTGACCCCAATCTGCCCAACAGCAATGGCACCAGAGGGGACTGTGGGAGCCCAGCCG
TAGGCATCATCTTCTTCACCACCTACATCATCATCTCCTTCCTCATCATGGTCAACATGT
ACATTGCAGTGATTCTGGAGAACTTCAATGTGGCCACGGAGGAGAGCACTGAGCCCCTGA
GTGAGGACGACTTTGACATGTTCTATGAGACCTGGGAGAAGTTTGACCCAGAGGCCACTC
AGTTTATTACCTTTTCTGCTCTCTCGGACTTTGCAGACACTCTCTCTGGTCCCCTGAGAA
TCCCAAAACCCAATCGAAATATACTGATCCAGATGGACCTGCCTTTGGTCCCTGGAGATA
AGATCCACTGCTTGGACATCCTTTTTGCTTTCACCAAGAATGTCCTAGGAGAATCCGGGG
AGTTGGATTCTCTGAAGGCAAATATGGAGGAGAAGTTTATGGCAACTAATCTTTCAAAAT
CATCCTATGAACCAATAGCAACCACTCTCCGATGGAAGCAAGAAGACATTTCAGCCACTG
TCATTCAAAAGGCCTATCGGAGCTATGTGCTGCACCGCTCCATGGCACTCTCTAACACCC
CATGTGTGCCCAGAGCTGAGGAGGAGGCTGCATCACTCCCAGATGAAGGTTTTGTTGCAT
TCACAGCAAATGAAAATTGTGTACTCCCAGACAAATCTGAAACTGCTTCTGCCACATCAT
TCCCACCGTCCTATGAGAGTGTCACTAGAGGCCTTAGTGATAGAGTCAACATGAGGACAT
CTAGCTCAATACAAAATGAAGATGAAGCCACCAGTATGGAGCTGATTGCCCCTGGGCCCT
AGTGAGAACACTCCAGCCTGGATATGTTCAGTTATGATGCGTCCTTCTGCTCTGTGTTAA
CTCTTTCCCATTGCAGATCACACCCAGCTACAGCCTCACCAATGCATGCCACTGGTCACA
ATGTCAGAACTGGGCAGGGAATGCAACTGGTAACCACCTTTGAAAAAACCATCATACACA
AATAGGAGTCAGAAGCTAAGAGCACTTCCACTGTGATTTCCCTTCTGAATTTCAATATCA
GATCATGGGTTCTCTTACTCTCCAGAAAATATCCCTTGTCCTTTTATTTTTGTTGTAATC
AGATTATATTTACTGAGACAAACTTCTCAGGACCAGAACTTCCAAAGATATAGAACAAGA
ACATTACTGAAGGTCCAAGGTAGTCCTCTGTGGAGCACCATACAGAGATTGGCAATATTA
TTTAGGATTTTGCATGACTGCATGTGAGAGCTGTCGGACAACTGCTCTGACCCAGGGTAA
CACCTGTGGCCTATGTCATGAAAAGCCTTTGAGATATCCATTAAAATTAATATTTTTAAA
TGTATGTCCACACCAGCGTTATATCATAAAGCATCATTTTATTTTTCTCTTATTTCTGTG
ATGCTGACCTGTATCATGAGTCACTTACCCCTCACTTTCTGGGATCCTGATATTTTCAG
TTTGAGATTGAGGCTGGGTGGAGCAGGAAAGAGCACTGTCCTGGGATCTGGAAATGCCAG
TTGGAATCCTAACTTTTCCACCAATTGTCTGGCTGACCAGGGCTAAAGTCTTTCCCCTCT
TAACTTCAATTTCCTCACTTGTAAAATTGGTGGGAAGGGAAGAAAATGAATGCTTTCTAT
AGACTTCGCATCTCGTGCTGTAGAACTCCATGGTGCCTGCCCCATTTATATGGGAAAAGC
ACTCTTTTCTGAGGCTGAAATGGCTGGACCTTTCTGTTGTGTAGCTAAAGAGGCAGCTTT
TGAATACATTCCAGAGTCTGTTCACATCTCATAATCAGACATTAAGGAGGAGAGTTTTTA
CATTACCTGGCGTCCAGAACTCCATAGTTAATATAATCAGAAGAAAAAGTATAATCATGA
GAATGATGATCCAGTAGATAAAAGGTATGGCCAGTAGTTTCTTTCATTCATCCTGCAAAT
GTTATTAATTACGTACTATATGATGGGCACTGCTCCAAGAACAAGAGATAAAATAGGAAT
TAAGCCCCCAAAAGATTAATTGTATGAACTGAATGGAGTAAGAATTGTCAGAGGAGTTTA
TTTAGGCCAAAGGCATGTTGCAGATTTTGAGATGAAGAAAAGCAAAGACTCCCTATAACA
ACATAGGACATAGGGATTGTAATGACAGTCATGATCTTCCATTAACTCTTGGCCCATTCC
CAGCCACAATCACAAAGATTCAAATATATAGCCAATTCATTGTCTATATATTTGATCATT
TCATAAGATTTTCCATTTGTATAATTACAAAGCACAGTGGCTGATACATCTCACATGCCT
CAAGAATACAGATTTGCCGAGGCCTTGCTCTCCCTTTTCTGTCACTATTAGCCCATAAGA
AGTCAAAGAGGCTCTCAAGATGCTTACTGGGAGTTGGCAGCATCCACAGATGCAGGTTAA
TAAGATGATGATGGGATAGCAGAGGTACCAAGCCATCTCAAATCAGCTATTCTCTGAATG |

TABLE 17-continued

SEQUENCES

| SEQ ID NO: | Human Allele | Nucleotide/Amino Acid Sequence |
|---|---|---|
| | | CCTGATTTATTCTAAAAGATGAGTTCAACCAAATAACTCTTCCTCTCTCGTACCACTGAA CCCGGGAGC |
| 137 | Human Nav1.9 amino acid sequence | MDDRCYPVIFPDERNFRPFTSDSLAAIEKRIAIQKEKKKSKDQTGEVPQPRPQLDLKASR KLPKLYGDIPRELIGKPLEDLDPFYRNHKTFMVLNRKRTIYRFSAKHALFIFGPFNSIRS LAIRVSVHSLFSMFIIGTVIINCVFMATGPAKNSNSNNTDIAECVFTGIYIFEALIKILA RGFILDEFSFLRDPWNWLDSIVIGIAIVSYIPGITIKLLPLRTFRVFRALKAISVVSRLK VIVGALLRSVKKLVNVIILTFFCLSIFALVGQQLFMGSLNLKCISRDCKNISNPEAYDHC FEKKENSPEFKMCGIWMGNSACSIQYECKHTKINPDYNYTNFDNFGWSFLAMFRLMTQDS WEKLYQQTLRTTGLYSVFFFIVVIFLGSFYLINLTLAVVTMAYEEQNKNVAAEIEAKEKM FQEAQQLLKEEKEALVAMGIDRSSLTSLETSYFTPKKRKLFGNKRKSFFLRESGKDQPP GSDSDEDCQKKPQLLEQTKRLSQNLSLDHFDEHGDPLQRQRALSAVSILTITMKEQEKSQ EPCLPCGENLASKYLVWNCCPQWLCVKKVLRTVMTDPFTELAITICIIINTVFLAMEHHK MEASFEKMLNIGNLVFTSIFIAEMCLKIIALDPYHYFRRGWNIFDSIVALLSFADVMNCV LQKRSWPFLRSFRVLRVFKLAKSWPTLNTLIKIIGNSVGALGSLTVVLVIVIFIFSVVGM QLFGRSFNSQKSPKLCNPTGPTVSCLRHWHMGDFWHSFLVVFRILCGEWIENMWECMQEA NASSSLCVIVFILITVIGKLVVLNLFIALLLNSFSNEERNGNLEGEARKTKVQLALDRFR RAFCFVRHTLEHFCHKWCRKQNLPQQKEVAGGCAAQSKDIIPLVMEMKRGSETQEELGIL TSVPKTLGVRHDWTWLAPLAEEEDDVEFSGEDNAQRITQPEPEQQAYELHQENKKPTSQR VQSVEIDMFSEDEPHLTIQDPRKKSDVTSILSECSTIDLQDGFGWLPEMVPKKQPERCLP KGFGCCPPCCSVDKRKPPWVIWWNLRKTCYQIVKHSWFESFIIFVILLSSGALIFEDVHL ENQPKIQELLNCTDIIFTHIFILEMVLKWVAFGFGKYFTSAWCCLDFIIVIVSVTTLINL MELKSFRTLRALRPLRALSQFEGMKVVVNALIGAIPAILNVLLVCLIFWLVRFCILGVYFF SGKFGKCINGTDSVINYTIITNKSQCESGNFSWINQKVNFDNVGNAYLALLQVATFKGWM DIIYAAVDSTEKEQQPEFESNSLGYIYFVVFIIFGSFFTLNLFIGVIIDNFNQQQKKLGG QDIFMTEEQKKYYNAMKKLGSKKPQKPIPRPLNKCQGLVFDIVTSQIFDIIIISLIILNM ISMMAESYNQPKAMKSILDHLNWVFVVIFTLECLIKIFALRQYYFTNGWNLFDCVVVLLS IVSTMISTLENQEHIPFPPTLFRIVRLARIGRILRLVRAARGIRTLLFALMMSLPSLFNI GLLLFLIMFIYAILGMNWFSKVNPESGIDDIFNFKTFASSMLCLFQISTSAGWDSLLSPM LRSKESCNSSSENCHLPGIATSYFVSYIIISFLIVVNMYIAVILENFNTATEESEDPLGE DDFDIFYEVWEKFDPEATQFIKYSALSDFADALPEPLRVAKPNKYQFLVMDLPMVSEDRL HCMDILFAFTARVLGGSDGLDSMKAMMEEKFMEANPLKKLYEPIVTTTKRKEEERGAAII QKAFRKYMMKVTKGDQGDQNDLENGPHSPLQTLCNGDLSSFGVAKGKVHCD |
| 138 | Human Nav1.9 nucleotide sequence | AAGGTTCTCCAAGGCCCCACCAGAGCAGCTAGATACAGAGTGTCGATTGGTGCACTCACA AACCCTGAGCTAGACACAGGGTGCTGATTGGTGTATTTACAATCCCTGAGCTAGATATAA AGACTCTCCACGTCCCCACCAGACTCAGGAGCTCAGCTGGCTTCACCCAGTGGATCCCGC ACCGGGGCCGCAGGTGGAGCTGCCTGCCAGTCCTGCGCCATGCGCTCGCACTCCTCAGCC CTTGGGCGGTCGATGGGACTGGGCGCCGTGGAGCAGAGGGCGGTGCTTGTCGGGGAGGCT CCGGCCGCACAGGAGCCCATGGAGGGAGTGGGAGGCTCAGGCATGGCGGGCTGCAGGTCC CAAGCCCTGCCCCGCGGGAAGTCAGCTAAGGCCCGGTGAGAAATCGAGTGCAGCGCCAGT GGGCCGACTCTGCTGGGGGACCCAGTACACCCTCCGCAGCCACTGGCCCGGGTGCCAAGC CCCTCACTGCCCGGGCCGGCAGGGCCAGCCGGCTGCTCCGAGTGCGGCGCCCGCCAAGCC CACGCCCACCCGGAACTCCAGCTGGCCGCAAGCGCCGGGTGCAGCCCCGGTTCCCGCTC GCGCCTCTCCCTCCACACCTCCCTGCAAGCTGAGGGAGCCGGCTCTGGCCTTGGCCAGCC CAGAAAGGGGCTTCCACAGTGCAGCGGTGGGCTGAAGGGCTCCTCAAGTGCCGCCAAATT GGGAGCCCAGGCAGAGGAGGCGCCTAGAGCGAGCGAGGGCTGTGAGGACTGCCAGCACGC TGTCACCTCTCACTTTCTTAGGGTCGAAGTCCTAGAAGTGAGAGAGCCGGCATGGGGGTC GCAGTTCATGCCTATGTTTATGGCTCTTTTGTTCCCATTTCATCACATTTTAAGAACTTT ACTGACTGGATGTGAGAAAAGACCCATGCACTTTCAGTTTTGCTTTTGCAATCCATAACT ATGGCCCAGTCAATTCCCTGTTCCTTTTTCTCTTGTTTGGGCCATGTGGCCACTTGCCTG CTACTTGCAGATCCCACTTCAGCAGTTCAGCCGGCTCAGCCTTATTGTCTTGCTTAATGT CTGGGTCTCAGTTTTAGAGACTGGGCTTCTTCTGCTCACTTGTTCCTGAACTCAACTTCC CGCCTTTTGCCAGGTCCTCCAGGAATGATGCCCTGCTTTGGTTTTGTCTATGCCAAAAGT TCCTGCTATACCCACAGTGGTGGTCATCTCTTCTGATCTTCACAGCCAATCAGCTCCCAA GGCCCCTGACCTCAGCTCAGCTTTTGTAGATCCTTATGACACCATCCTTTAAGACTGGAA TCCTAGGGCAGGCTGTTTTATTCCCGCCTCCTGAGGGCCTTTCTGAGGATCTGTGGCTTGT CTCTGTCCTGAGGGTGAAGATGGATGACAGATGCTACCCAGTAATCTTTCCAGATGAGCG GAATTTCCGCCCCTTCACTTCCGACTCTCTGGCTGCAATTGAGAAGCGGATTGCCATCCA AAAGGAGAAAAAGAAGTCTAAAGACCAGACAGGAGAAGTACCCCAGCCTCGGCCTCAGCT TGACCTAAAGGCCTCCAGGAAGTTGCCCAAGCTCTATGGCGACATTCCTCGTGAGCTCAT AGGAAAGCCTCTGGAAGACTTGGACCCATTCTACCGAAATCATAAGGTACTTCATTGGGC GGGGGGGGGGGTGGGGTGGGGTGTTCTAACCATGCAGTTGTAACTGGTGTTACAGGT TCTCCAAACACCACTCTTAGGGTTTATAGCAGGCAGGCTGTGCCTCTTCTTTGCTGTCAT CCCCTGGCATTGCCTTGATAGTCCTGAAAACCCCTTTCAGTCCTCATTTTTTCTCTGCAA TGCATGTATTAGAGGAGAAGATGAGGATGAGGGACTGCAAAAGGATAAAAGGAAAACAGA GAAAACACAAATGAAGTCTGGAAAGAGGACTGGACTAGTAGTCCCAGAAGTTAGATACA GGCCATTTCAATTGATTGGCTTTATGACTCTGGGCAAGTCACTTTACTAATCTTCACTTT TAAAATCTGTATAATAGAAATAATGCCTGATGTTCCTACCTTAGAGCATAGACATGCTGG GAAAGCACTTTATCACTATAATGCATTATACTGATACAAAGGATTAATATCATGGTCCAG AAATGCTCATTATAGCAACAAGATTTTACCTTAAAAACTCTTGGATAATAGGCTTTCTAG GCTATTAAATGAGACTAATAGGGCTCAAACCAACAACTGATGCATAGTAGGAGCTCAATA AATGAAACCTAAGAAAATGGTAACCAAGTGGGCACATGCAGATTCTATGTAAACTCAATG CAAATATGTGAAAGCCTTGCTATTTTATCTGCCTGGATGCAGTTCTTGCAGGGAAATTCT |

TABLE 17-continued

SEQUENCES

| SEQ ID NO: | Human Allele | Nucleotide/Amino Acid Sequence |
|---|---|---|
| | | AGTAAAGGTTTCTTGAAGGGGCTCCCGAGTGAGGGAATGTAAACTTTGAGCTCCCACATG
ACTGCTCTAGAGCCTGAGGCTGTGAGCACACTTGGCCCTTTCAGGAAAGGCTCAGAAGAT
TTTGCCATCATCACCTCGCAGTGTGATCCAGCAGAGGTTGGAAACCCCACCTTGCCATAC
TGAGGTTAGAGACCTAGGAGGCTGGGAGGTTTGGGGAAGCCCTAGAAAATATGGGATGCT
GAGAGCATCTTTGGCTGGCATCCATAAGAAACTGACCTTTCAAAGAAAGATTGCCTGATT
TGCATGTACTTCAATTGGGATAGACTTAGAGTTGCCAGGCCAAATGAGGACCACATATAC
AGAGGAAAGTAGAGTATAAGTAGGAAGGACAAGCAAGGGGGAAAGAATTGAAGGAGCAAA
AACACTCCAATGTTTCTCCTTTTTCTGATGCCCCAGGATTCCAGGGCCTTCTTGGAGGTA
TAGTTGTTGGAGGTGAGTTAACTGTAGAGGTCTCCTTCTGCATCAATGCTGGAGAGGAGA
CGCATGAGTCAGGCAGCAGTTTGGTGTGCAGCTGACAGTCCGGGAGAACAGGACTATTCC
AGCCTGGGTGGTAATTCTAGGACCACCACTTCTCAGCCTGGGTCCTCACTTTAAATAAGA
AGACACGATATCTGTTTAGAGCTCTGCACACCCATGATCTCACATGACCAGTGCCCTCAA
CAGTCATGTGAGGTATGTGTGATCATGATTAGCACTCTACCTTACAGATGAGGAAACCAG
AGCCTAGCTGGGAAAGTGGCTTAAGCCAGGTCAAGCAGCCAGTGAGTGGTGGAGCTAGGA
TGCAAACCCAAGGGTGCTTTTTATCATCACAGGCTACTTCTCTTTGGAAGCCCCATTTTG
AAGAGCAACAGGGGAAAGAAGTAGAGAAGTGTCAGCAAGCAGGCAGGAGGAGCTAGTACC
TATCATTTTAATCATTAAAACCCTGGCATGTAGAGTTAAATACACCATTAGTTAAAATAT
TTAAAGCAGTAAGAAGAGGCATCAATAAAATATCAAAATCAAAGGCACAGAAGGAGAGCC
ATATTGTACCACTTATTAATGTGGGGTGACTCATCTCAAAGAGAGGTTTGTTTCTGCCCC
AAAATTGTATGTCTGTTCAAAGGAAAGGCGCAGAATTTCCAAAGCAGGTCTTGGGCTCCT
GGCTCATATTTTTAAAAAACCCCGTGGCTCATTTCATTATTATGGGGGCAAAGAAAAATA
CCCTAGCACAGTTTTCCCTGCAGCCAGATAACCATCAGACCAGTCAATCCCAGCAGCTCA
TTAAAGGAAGGTTGATGGTTGGCAGTGGCTGACGTTCTGGCACCTGAGCCAAGGTAGCAC
TCACAGTGCTAACGTTGGGCCTGGGTGCCGAGGTCTGTCTCTCCTGCCTGAGAACATGCT
GTATTACATGGCCAAGTAGTACTTTTTGCAAATCTGAAAGGAGCCATCAGTTGGGGAGAA
AGGAATGACTCTTACTTTCTGAAGGCTTTTGTAACTGATAGCCATGGGACAGATATGGG
GACAGCTAGATTACAGTTACATGGAAAAAGGGAGGTCTGGAGGTGGATGTTAGAAGCATG
TTAGTGACAGGTTGTTGTCCAGGGGCTGCTTCATTCCCAGTGCCCAGGGAGTCATGCTAG
GAGAAAATGGGCAGAGGTTCAGTGTTCTTTAATGGGACTCCACTGGGCACTTTGTGGGGG
GGCGGGCATAATGTACCATTGGCAAGTTTGTCCTGTTTGGCATCCCTGGGTCTTCCCAGT
AAAAGGCCGGTAGAGCCCATAGTCATTACAGCAGACAACCAAAAATACTCACACACATTT
CCAAATGCCTTCTGTAGGGGCAATGCCCACCTCCCCTGCTGGTTAAGAACCACAGGGAAA
TTTGCCCCTATGTCCACAGAGGTAAAGAAAGAGCAAATCCAGGAAACTTGGTGACTTTTT
TCTTGAAGATCATCAAGGTTAGAATTGACTGGTTATTTCACACAGCATTTCTCAGACCTG
TGGCATAGCAAACATGGACCCTTTAGGTCACTTATTCTAAGATTCATTGCAAAGTTTTCG
TTAATAATCAAAATAATTTAAAATAATCTGCTGAATCTAAATGTCCAAGCTCAATTTCTG
CCTCTTCAAGTTCTCTTCTAGTCCCTTTCCCCGTTGATACGTACCATGGAGTACAATATT
AAGGGTTTTCTTTTCCCCAGTTATTCCTCTATACTCCTAATTTTGGTATTTTCAGGTCCT
GTGTTTTCCATCTCTGATTCTTCTGGAGTATCCCATTGGGTAAATATTCCACAGCCCAAC
AGTTTATGTTATAATTTTCTCTAAATGAATTCATGATAAATATTGTTTTGTCACTGCATT
TAATTCCTGTTGTGTATGTGTGTGTTTTCTTGTATTGTTTTTTTTGTTTTGCAGACATTT
ATGGTGTTAAACAGAAAGAGGACAATCTACCGCTTCAGTGCCAAGCATGCCTTGTTCATT
TTTGGGCCTTTCAATTCAATCAGAAGTTTAGCCATTAGAGTCTCAGTCCATTCATATCCT
TTCATTGCACCTTTTACTAAGTCCAGATCATTTGAAAAGTGCACGTGCCCCACGGTGTTC
ATGTTATTGGATGGAAGCAAATAGCTAATTCTTTCTACAAATACTGGCTGAGTGCCTACT
GCTGCAGGCAGGGACTGTGCTGGATGTGAGCAAGATGTCGTCTCCTTCTCTGGGGTCCTA
TGGCCTCAGAAGGGCATAGACTAAAAGGCAGGCAACTTCTTTAGTGAGATTGGTCGTGTG
AAAGTGGTAGCAGGGAGAGGCACTGCTGTGCTTTAGAGGGCATCAAGGATGGCTTCTTAGA
GGAAGGTGCATCTAAGCTGACACCTAAAGAGTTGTAAACTGGCAACCTGTGCAGTATATT
GAGTTGATAATGTGTTGTGTTGGACCTACACAGTATTTAAAACTTTGAAAAACACTTTCT
AACATGAATACTCCAGATTTCCAGCTTTTCTTGAAAGATGGAAACTGGCAAGGGTAGGTT
CCCATTTCTGTTAATACCTGACAAAAATGGGTAGAGTAAGGAATTGCTGCCTCTTTGGAG
GGGGCATGTAAGCTCTGTCTCACCACCTCTGCACCCCTCTTGTGGCTGAACACCAGCCCA
TTTTACCCATTTATATGCCTTTTCAGGCTCTTAAAACTTAGGGTTTGCAATGTCAGTCTT
AAAATGTAAAGGCAGGTAGGAATTATTAAGCATTTCTGCTGTATGCCAGGGTTGGGGGAG
ACACTAGGAAGTTTTAGACAGGGAAATGAGAAAAAGATATGGGTTGGTAGATTTAGTAAA
ATATTGAGGAGAATGGCAATGAATAACTATTTGGGTTTGGTTCCCTAGAAGCAGAGCCTG
ATATGGGCATTCTTATTTAAGTGATTTAACAGAGGAGTGCTTTCTGGAGAAGGAGAAAGG
GAAGCAGAAGGGGGGAAAACAAAGAGCCAAGCAAGGATATGGTCTCAGCTGAGTCACCTT
CATTCTGATCCCACGAAGAACTCTGGAGCATGAATTGCACCACAGAATTGTCCCACTTTG
AAGCAAGGGCCTAAGTCAGTCAGACATGTAGAAGGGGGTGTGTAGCTCTCCAAGTGAGGA
GGCTGCCATTCAGCAGGGGACAATTCTCCACAGGAGGGGACAGTTGTGAGTTGTTCTCAT
CCAACATTCACAGTCAGAAGATAGATGCACCTGCAGAAAAGGGGACCATCAGGGGCACCC
CCAGTCTTACCCAGTAGCTAATGATGCATGCCATCCTGCAACATATCTGCCTTAATGGAT
GCTGGCCACATTGTTCAGCATGTTCATTATCGGCACCGTTATCATCAACTGCGTGTTCAT
GGCTACAGGGCCTGCTAAAAACAGCAACAGTAACAATACTGACATTGCAGAGTAAGTATT
TTTCCTTCACTCACCTGTCCTAAGTTTTTAAACAAATATACCTAAGACAGTTAATGATTA
CACTGGAGAGAAAGAAAAAGTCACTAATAATTCTAACACATATGTTGGCAGAATCAGTTT
TATTTTTGACCTTTATTTTTTTACAATTTGTAATGAACAGCACACATATGTTCACATTTT
AAGTGGTTTTCTTTGTGTTTACATAAGTTTTATAGGTATCCATTTTGATGGTTATATAAT
ATTTTATCAGGTGAATAAACCATAATGTACTTCACCACTCTAGCATTTTAGTAGATTGTA
ACATTGTCATAAAAATCTTTTTGCATAAAGCTGTATTTATGTATTTACTTATTCTTTGTT
TTGTTTGTAAAAAATTGTTATGGGAGTTCACTATGCCAAAAATAAAGCTATTCTTTTTTT
TATTTTTTTTATTTTTTGAGACAGGGTTTTGCTCTTGTTGCCCAGGCTGGAGTGCAATG |

TABLE 17-continued

SEQUENCES

| SEQ ID NO: Human Allele | Nucleotide/Amino Acid Sequence |
|---|---|
| | GCACTATCTCAGCTCACTGCAACCTCTGCCTCCCAGGTTCAAGCGATTCTCTTCCCTCAG
CCTCTCAAGTAGCTGGGATTACAGACGCCTGCCACCGTGCCCAGCCAATTTTTTGTATT
TTTAGTAGAGACAGGGTTTCACCATGTTGGCCAGGCTGGTCTTGAACTCTTGACCTCAGG
TGATCTGCCCACCTTGGCCTCCCAAAGTGTTGGGATTACAGGCGTGAGCCACTGCACGCA
GCCCTATTCTTAAATTATTATTTTCTTGAGATACACTCTTAGAAATGGATTTTCTAGGCT
GGGCGTGGTGGCTCATGCCTGTAATGCCAGCACTTTGGGAGGCCAAGGCGGGTGGATCAC
GAGGTCAGGAGATCAAGACCATCCTGGCTAACATGGTGAAACCCCATCTCTACTAAAAAT
ACAAAAAATTAGCCAGGCGTGGTGGCGGGTGCCTGTAGTCCCAGCTACTCGGGAGGCTGA
GGCAGGAGAATGGCATGAACCTGGGAGGCGGAGCTTGCAGTGAGCCCAGTGAGCCACTGC
ATTCCAGCCTGGGCAACAGAGTGAGACTCTGTCTCAAAAAAAAAAAAATGGATTTTCTAG
ATAAAAAGGTACATTTTAATGCTTTTAATGATATATATAGACAAAATGTTTTCCAAAAAG
TTTGTATCAATTTGCTCTGCCATCAGCAGTGTATTCTAATAACCAATTATATCACATTCT
TGCTAGCATTAAATTTTTTCTTCTCTAATTTATGGAGTTAAAAATATTAGCATTTCTTTA
ATTTCCAGATGGGTTAGACTTAAAACAATTTTAATTGACACATAATAATTGTACACATTT
CAGGGTACATGTGATATTTTGATACATGCATACACTGTGTAATGATCACTTAAGGGTAAT
TGGGATATCAATCCCAATTGGACATTTATTATTTCCTTGTATTGGAAACATTTCAAATCT
TCTCTTCTAGCTATTTTGAAATATACAATAAATTATTATTAACTAAATAGTCATCCCACT
GTGCTATTGAACACTAGAATTTATTCTTTCTGTCTGTTTTTGTACTCATTAATCAACTT
CTCTCCATTCCTCACCTCTCACCCAGTCTTTCCCCATCTCTGGTAACCACCATTCCATTC
TCTACCTCCATGTGATCCACTTTTTCAGTTCCCATATATGAATGACAACATGAAATATTT
GATTTAGACTCTTTTAATGTTTTCATTTCTGAATTGTGTGTTTCCATCTTTGCTTCTGTA
TCATTTTTATTTCTTTTCTAATCAGTTTGAGTTCTCTGTATAACCAAAATATTAACTTTT
TATCATTTGCATTGGCTTTTCAGACATATGAATTAATGTTTTAACTTAAAAGTTCTATAT
TTGTATAAATATTTTCTTATCAAAAGTTCCAGTTTTTCTAGTTTAACATAATTACTGCTT
TAATCTTTCAGGAACATATTGAATGCAAATTGAATAAATGAGACCATTTTTTCTAACTCC
TATTTAATTATGCAATATAAACCACTGCAATCGATATATAGACCATTTCAATTACCCCCC
AAAACGTCTCATGCCTCTTTGCAGTTAATCCCCGATTCCCACTCCCAACCCCAGACAAAC
ATCGATCTCATTTCTGTCATTCTAGACTTGTTTTGCCTTTTTTAAGAATTTCGTATACAT
TTCATATGCTATGTATGATACTATATTTTTGTATCTGGTTTCTTTCATTTAGCATAATGC
TTTGAGATGCATCCATGTTGTTGTGTATATTTCTACATTTTTTTTTCTTTTTGTTGCTA
AGTTGGATTCCATTGAATGGATATAGTTTTCCCATTTATCTATTGATGCACATTTGCATT
ATTTCCAGTTTAGGGCTATTATGAATAAAGTTGCTGCGAACACTTCCGTATAAAAATCTT
TTGTGGATATTTTTGCATTTCTCTGGGATAAATACCTAGGTGTAATTGCTGGGCCCTGCG
ATAAGTATATATGTAACTTTCTAATAAACTGCTAAACCTTTTTCAAATTGACAGCATAAT
TTTACATTCATATCAGCAATATATGAAAGTTTCAAAGTCTTTATTAATTTTTTCATTCAA
TTTGCTTTGATTTTAATTTGCTCTTCTTTTTCTAGCTTCTTAAGTTGGAAGCTTAAATAG
TTGGTTTTAGATTTTTCTTCTTATACAATTGTATAAAGCTATGCATTTCTGTCCAAGAAC
TGCTTTAGCTGCATTCCACAGATGTCAATACACTGTGTTTTTATTACCTTTTGGTTCAAA
ATATTCCCTACATTTTCTCATGATTTCTTCTTTGTCCCATATGTCATTTAGAAGTGTGTT
TTTTAATATTTCCAAATATTTTATACCTTTCTAGTTGTTTTCTGGTTGTCTGATTATTAT
CTAATTTCAGTTCAGTTATGATCAGAGAATACACTCTGTAAAATTTCAATCTTTTGAAAT
AAAGAGAAACATCTTTTATAGTCTATCTTGGGAAATGTTTCACATGCACTTGGAAAGAAT
GTGGATTCTGCCACATTCTTAAATACTCCTTAAAAGGTCAGTTAAGTTAAGGTGGTTGAT
AGTGTCATTTAGATCTTTTGTACCTTTACTGATTTTTACTTAGCATTTTTATGAATTACT
GAAAGAGAGGCTTGAAATCTCTATCTATGATTGTGGATTTGTCTGTTCTTTCTCTCTTTT
TGTCAAATTTGGCTTTGTGTATTTTGAAGCACTATTATCAGGTACATACATATTTACGAT
GATTATTATTATCCTCCTGATGTATTCATTCTTTTATTATTATGGAATGTCTTCTTTGTC
TCTAATAATACTCATTTAAATATTTGTTTTGTCTAATATTAATATAGCTACTTCAGCTTT
CTTAAGCTCTTTGTTTGCATGGTATATCTTTTTCCATTCTTTTACTCTCAAACCTTCTGT
GTCTTTGTATTTGTAGCGTATATCTTGTAAACAACATATAGTTGGTTTTTGCTTTTTATG
CAGTCTATCAATCCAGTCTCTGACTTTTGATGACTAAAGTTCATTTACATTTAATATAGT
TATATAATTGGATTTTGCTTTGCTATTTTTCTATTGGTTTTCTATTTATCTCTTTTTTTT
TTTGTCATTGTTGTTGTTCCTTTGCTACTCCATTATTTCTCCATTCCTGCTTCCTTTTGT
GTTAATCATGTATATTTAGTATTTCATTTAATCCTCTGCTGGCCTTTTAGCTTTACCTA
TTTGCATTTTTTAGTGGTTTCTTCACATATTAAACAATGCATTGTTAAATTGGCAAAATA
GAGTTAACGTTGAATTCCTTCAAGTGAAACAGGAACCATGCCACAGTTTAGTCCCCTGTT
TGTTTTTTATCATATAGTTATGCTAATGTACACAATAAACCCAACAATACAGTTTATCAT
TTTTGCTTTTAATGGGCACATGCCTTTTAAAGACATTTTTTTTCCTGTAGATCCAAGTTA
TCTTTTGGTAGTATTTCTTTTTAGCCTGAACAACTTCCTTTAATATATCTTGTGGTTCAG
TTCTGTTGGCAACCCATTCTCAGTTTATATTGATCTGAAAATGTCTTTATTTCATACTCA
TTTATGAAGTAGAGTTTCATTGTATATAGAATCAGTGCTTGACAATTTGTTTTTCTAGCA
CTTTAAGTATGTCATTTCCATGTTTTATGCCTCCTGTTGCTAGCTCTCTCTTGCATGCT
TCCAGGATTTCCTCCCTAAATTTCCAGCTGCTCTGCCAGCTCTGAACCCCACCCTCGGCC
ACCTTAAATCTTCAGGACTGCAGCCATTTGCCAGTGTTGGGGTGGGAGTGGGGAAGTTGG
AAAACACTCTCAGACCAAAACAGTTAAACATTTTCATAATTCTTATGCATTGCAGGTACC
TTCTTTTAAGGGGAAACTCTGCCCCAGTTTCTGCCTCCTTTTGTTTACCTTCCAGGGCCT
TCAAATAATTGTCCTTATATATATTTTCCAGTTTAATACTCATTATCTGTGGGAGGGT
TTGCCCAGCTACTTCATGTCTTCATCACAATTGAAGCAGGCATCAATGGTCTCTTAATTT
TGCTTATTATTTTTTCTTTTCCTTTATTAAATTTAACAAACTTTCCTCTATGCCCGTGG
ATTTTGATTTATAGTTAGAAACACTTTCTCTAGCCTTGAGTTATAAAAGGACTCTCTCAT
ATTTTCTTACAGTGCTTTTATAGTTTCCTTTTTTAAAAATTTAAATCCTTGAATAATTTG
GAATTCATTCAAGGGTAGGGTGTCATAAATAGATCTGACTTCATAGTTCCGTCCCAGATG
TCTATCCATTTGTCCCAACACCATTTGTTAAATAGTCCACCTCTTATCCTCTGATGTGAA
ATGTTACTTAGGTATTCAGATCTATTTCTGGACTTTCTTTTCTCTTCCATTGGTCTGCGT |

TABLE 17-continued

SEQUENCES

| SEQ ID NO: Human Allele | Nucleotide/Amino Acid Sequence |
|---|---|
| | TTTCATATGCCAGAACCACACTTTTTAACTATCAAGATTGTCTAATGTTGTAATGTCTAG |
| | GAGTGCTAGAGGTTCCTTTTGAGAATTTTTATGGCTCTTGTTGATTTTTTCATGTAAATT |
| | TTATAGTCAACTTGGTTAGTTTTATTGACATGATGAAAGGATTTATAAATTAACCTAGAG |
| | GAAACTGACATCTTTATGAGGTTGGAACTCATTGAGAACATGACATATTTTTCATTTGTT |
| | AAAATCTTCTTTTGTGTTCCTCTAATTGCTTTAAAGTTTTCTTCATACAGATCTTCCACA |
| | ATTCTTGTTAAATTTGTTTGTGAATTTTACTGTTTTTTGTTGCCATTATAAATGTGGTCT |
| | TTTCTTTCATTATGCCTTGTAACTAGTTGCCTTGTTATATAAAACTATATATATATATAT |
| | ATATGTATGTACATCAGTATTATACATATCAATATTTTATATATATATAAAATTGTGTGC |
| | TATTTTTGATAAAATTTGTTGTCAGCATTTGTTTACTCTTTTGATGACTTGTATGGCTCC |
| | TCCCCATCTTTCCCATGTATTAAATTTTTTTTTTTTGAGATGGGGTTTCACTCTTGTC |
| | GCTCAGGCTGGAGTGCAATGGCGCGATTTTGGCTCACCACAACCTCCTCCTCCCGGGTTC |
| | AAGCGATTCTCCTGACTCAGCCTCCAGAGTAGCTGGGATTACAGGCATGCGCCACCACAC |
| | CTGGCTAATTTTGTATTTTTAGTAGAGATGGGGTTTCTCCATGTTGGTCAGGCTGATCTC |
| | TAACTCCCGACCTCAGATGATCCACCCGCCTCGGCCTCCCAAAGTGCTGGGATTACAGGC |
| | AAGAGCCACTGCGCCCGGCCTTGAAATGTTTTTAATAGCATGGAAATGAGGTATTCTGGG |
| | AGAAAGAAAGAGAGAATTATCCAGTAAAGTGATTTATATCTGCAAATCTTTTGGAGAGGG |
| | ATATAAGGAATTAGTGAAATGGGAAGGAATTCATTTATTAATAGCTTTTTCATTTTTCAT |
| | TGGTAATCTTTTCAGTTTTAAAATTTCTCTGAATATTTTGCTATATTCTTCTTCTCATT |
| | TATCATTTTGTTCATATGTTTTCTTTTTTCTGTGATTAGAATTGCCAGAGGCTTGCCTAT |
| | TTTTATGTTTTTTTAAACTATATCTTAAATTCCATTTTAAAAACTATTCTATAGTTTTTC |
| | TATAACTATGTCTTAAATTCTATTTGTCTTAAATTCTATGTTTTTCTAAAACTATATCTT |
| | AAATTCTATTTATGTATTAAATTCTATTTTTATTTTATTAGTATTTTTTGAGACAGAATC |
| | TCGCTTTCTTGCCCAGGCTGGAGTGCAGTGGAGCAATCTCTACTCACTGCAGCCTTCGCC |
| | TCCTGGATTCAGGAGATTCTTGTGTCTCAGCCTCCCAAGTGACTGGGATTACAGACATGC |
| | ACCACCACGCCTGGCTAATTTTTGTATTTTTAGTAGAGATGGGGTTTTGCCATGTTGCCC |
| | AGGTCTTGAACTCCTGGACTCAAGTGATCCGCCTGCCTAAGCCTCCCAAAGTGCTGAGAT |
| | TACAGGCATGAGCCACCAGCACCTGGCCTTAAATTCTATTTAAAAATATAATATTTTTGGC |
| | CGGGCGCCGTGGCTCACCGCCTGTAATCCCAGCGCTTTGGGAGGCCGAGGCGGGCAGATA |
| | ACCTGAGGTCGGGAGTTCAAGACCAGCCTGACCAACATGGAGAAACCGCGTCTCTACTAA |
| | GAATACAAAATTAGCCGGGCATGGTGGCACATGCCTGTAATCCCAGCTACTCAGGAGGCT |
| | GAGGCAGGAGAATCGCTTGAACCTGGGAGGCAGAGGTTGCAGAGAGCAGAGATGATGCCA |
| | TTGAACGCCAGCCTGGGCAACAAGAGCAAAACTCTGTCTCAAAAAAAAAAAAAAAAAAAA |
| | AAAAAAAAAAATATATATATATATATATATATATATATATATATATATGATATTTT |
| | TCCTTCTGCCTTCTTTTATTTTCTTCATTATACATTCAATAGGACATAACATTTTCTAAA |
| | ATATGAATTTGAATGTTTAGTTCATGCATTTTCCTTCTTTTTTGTTTTTTATTTTATTAT |
| | TATTATACTTTAAGTTTTAGGGTACATGTGCACAATGTGCAGGTTAGTTACATATGTATA |
| | CATGTGCCATGCTGGTGTGCTGCACCCATTAACTCGTCAATTAGCATTAGGTATATCTCC |
| | TAAAGCTATCCCTCCCCACTCCGCCCACCCCACAACAGTCCCCAGAGTGTGATGTTCCCC |
| | TTCCTGTGTCCATGTGTTCTCATTGTTCAATTCCCACCTATGAGTGAGAATATGCGGTGT |
| | TTGGTTTTTTGTTCTTGCGATAGTTTACTGAAAATAATGATTTTCCAATTTCATCCATGTC |
| | CCTACAAAGGACATGAACTCATCATTTTTTATGGCTGCATCGTATTCCATGGTGTATATG |
| | TGCCACATTTTCTTAATCCAGTCTATCATTGTTGGACATTTGGGTTGGTTCCAAGTATTT |
| | GCTATTGTGAATAGTGCCGCAATAAACATACGTGTGCATGTGTCTTTATAGCAGCATGAT |
| | TTATAGTCCTTTGGGTATATACCCAGTAATGGGATGGCTGGGTCAAATGGTATTTCTAGT |
| | TCTAGGTCCCCGAGGAATCGCCACACTGACTTCCCCAAGGGGTTGAACTAGTTTACAGTTT |
| | ACAGTTCCACCAACAGTGTAAAAGTGTTCCTATTTCTCCACATCCTCTCCAGAACCTGTT |
| | GTTTCCTGACTTATTAATGATTGCCATTCTAACTGGTGTGAGATGGTATCTCATTGTGGT |
| | TTTGATTTGCATTTCTCTGATGGCCAGTGATGGTGAGCATTTTTTCATGTGTTTTTGGC |
| | TGCATAAATGTCTTCTTTTGAGAAGTGTCTGTTCATGTCCTTCGCCCACTTTTTGATGGG |
| | GTTGTTTGTTTTTTTCTTATAAATTTGTTTGAGTTCATTGTAGATTCTGGATATTAGCCC |
| | TTTGTCAGATGAGTAGGTTGCGAAAATTTTCTCCCATTTTGTAGGTTGCCTGTTAACTCT |
| | GACGGTAGTTTCTTTTGCTGTGCAGAAGCTCTTTAGTTTAATTAGATCCCATTTGTCAAT |
| | TTTGGCTTTTGTTGCCATTGCTTTTGGTGTTTTAGACATGAAGTCCTTGCCCATGCCTAT |
| | GTCCTGAATGGTAATGCCTAGGTTTTCTTCTAGGATTTTTATGGTTTTAGGTCTAACGTT |
| | TAAGTCTTTAATCCATCTTGAATTAATTTTTGTATAAGGTGTAAGGAAGGGATCCAGTTT |
| | CAGCTTTCTACATATGGCTAGCCAGTTTTCCCAGCACCATTTATTAAATAGAGAATCCTT |
| | TCCCCATTGCTTGTTTTTGTCAGGTTTGTCAAAGATCAGATAGTTGTAGATATGCGGCGT |
| | TGTTTCTGAGGGCTCTGTTCTGTTCCATTGATCTATATCTCTGTTTTGGTACCAGTACCA |
| | TGCTGTTTTGGTTACTGTAGCCTTGTAGTATAGTTTGAAGTCAGGTAGCGTGATGCCTCC |
| | AGCTTTGTTCTTTTGGCTTAGGATTGACTTGGTGATGTGGGCTCTTTTTTGGTTCCATAT |
| | GAACTTTAAAGTAGTTTTTTCCTATTCTGTGAAGAAAGTCATTGGTAGCTTGATGGGGAT |
| | GGCATTGAATCTATAACTTACCTTGGGCAGTATGGCCATTTTCACGATACTGATTCTTCC |
| | TATCCATGAGCATGGAATGTTCTTCCATTTGTTTGTATCCTCTTTTATTTCATTGAGCAG |
| | CGGTTTGTAGTTCTCCTTGAAGAGGTCCTTCACGTCCCTTGTAAGTTGGATTCCTAGGTA |
| | TTTTATTCTCTTTGAAGCAATTGTGAATGGGAGTTCACTCATGATTTGGCTCTCTGTTTG |
| | TCTGTTGTTGGTGTATAAGAATGCTTGTGATTTTTGTACATTGATTTTGTATCCTGAAGA |
| | CTTTGCTGAAGTTGCTTATCAGCTTAAGGAGATTTGGGCTGAGACAATGGGGTTTTCTA |
| | GATATACAATCATGTCATCTGCAAACAGGGACAATTTGACTTCCTCTTTTCCTAATTGAA |
| | TACCCTTTATTTCCTTCTCCTGCCTAATTGCCCTGGCCAGAACTTCCAACACTATGTTGA |
| | ATAGGAGTGGTGAGAGAGGGCATCCCTGTCTTGTGCCAGTTTTCAAAGGGAATGCTTCCA |
| | GTTTTTGCCCATTCAATATGATATTGGCTGTGGGTTTGTCAGAGATAGCTCTTATTATTT |
| | TGAGATACGTCCCATCAATACCTAATTTATTGAGAGTTTTTAGCATGAAGGGTTGTTGAA |
| | TTTTGTCAAAGGCCTTTTCTGCATCTATTGAGATAATCATGTGGTTTTTGTCTTTGGTTC |
| | TGTTTATATGCTGGATTACATTTATTGATTTGCATATATTGAACCAGCCTTGCATCCCAG |

TABLE 17-continued

SEQUENCES

| SEQ ID NO: | Human Allele | Nucleotide/Amino Acid Sequence |
|---|---|---|
| | | GGATGAAGCCCACTTGATCATGGTGGATAAGCTTTTTGATGTGCTGCTGGACTCAGTTTG
TCAGTATTTTATTGAGGATTTTTGCATCCAAGTTCATCAAAGATATTGGTCTAAAATTCT
CTTTTTTGGTTGTGTCTCTGCCTGGCTTTGGTATCAGGATGCTGCTGGCCTCATAAAATG
AGTTAGGGAGGAGTCCCTCTTTTTCTATTGATTGGAATAGTTCAGAAGGAATGGTACCAG
TTCCTCCTTGTACCTCTGGTAGAATTTGGCTGTGAATCCATCTGGTCCTGGACTCTTTTT
GGTTGGTAAGCTATTGCCACAGTTTCAGAGCCTGTTATTGGTCTATTCAGAGAGTCAACT
TCTTCCTGGTTTAGTCTTGGGAGGGTGTATGTGTCGAGGAATTTATCCATTTCTTCTAGA
TTTTCTAGTTTATTTGCATAGGGGTGTTTGTAGTATTCTCTGATGGTAGTTTGTACTTCT
GTGGGATCGGTGGTGATATCCCCTTTATCATTTTTTATTGCTTCTATTTGATTATTCTCT
CTTTTCTTCTTTATTAGTCTTGCTAGGGATCTATCAGTTTTGTTGATCCTTTCAAAAAAC
CAGCTCCTGGATTCATTAATTTTTTGAAGGGTGTTTTGTGTCTCTATTTCCTTCAGTTCT
GCTCTGATTTTAGTTATTTCTTGCCTTCTGCTAGCTTTTGAATGTGTTTGCTCTTGCTTT
TCTAGTTGTTTTAATTGTGATGTTAGGGTGTCAATTTTGGATCTTTCCTGCTTTCTCTTG
TGGGCATTTAGTGCTATAAATTTCCCTCTACACACTGCTTTGAATGTGTCCCAGAGATTC
TGGTGTGTTGTGTCTGCTCTCGTTGGTTTCAAAGAACATCTTTATTTCTGCCTTCATTTC
GTTATGTACCCAGTAGTCATTCAGGAGCAGGTTGTTCAGTTTCCACGTAGTTGAGCGGTT
TTGAGTGAGTTTCTTAATCCTGAGTTCTAGTTTGATTGCACTGTGGTCCGAGAGACAGTT
TGTTATAATTTCTGATCTTTTACATTTGCTGAGGAGAGCTTTACTTCCAACTATGTGGTC
AATTTTGGAATAGGTGTGGTGGTGCTGAAAAAAATGTATATTCTGTTGATTTGGGGTG
GAGAGTTCTGTAGATGTCTATTAGGTCCGCTTGGTGCAGAGCTGAGTTCAATTCCTGGGT
ATCCTTGTTAACTTTCTGTCTCGTTGATCTGTCTAAGGTTGACAGTGGGGTGTTAAAGTC
TCCCATTATTATTGTGTGGGAGTCTAAGTCTCTTTGTAGGTCACTCAGGACTTGCTTTAT
GAATCTGGGTGCTCCTGTATTGGGTGCATATATATTTAGGATAGTTAGCTCTTCTTGTTC
AATTGATCCCTTTACCATTATGTAATGGCCTTCTTTGTCTGTTTTGATCTTTGTTGGTTT
AAAGTCTGTTTTATCAGAGACTAGGATTGCAACCCCTGCCTTTTTTTGTTTTCCATTTGC
TTGGTAGATCTTCCTCCATCCTTTTATTTTGAGCCTATGTGTGTCTCTGCACATGAGATG
GGTTTTTCCTGAATACAGCACACTGATGGGTCTTGACTCTTTATCCAATTTGCCAGTCT
GTGTCTTTTAATTGGAGCATTTAGTCCATTTACATTTAAAGTTAATATTGTTATGTGTGA
ATTTGATCCTGTCATTATGATGTTAGCTGGTTATTTTGCTCATTAGTTGATGCAGTTTCT
TCCTAGCCTCAATGGTCTTTACAATTTGGCATGATTTTGCAATGGCTGGTATCGGTTGTT
CTTTTCCATGTTTAGTGCTTCCTTCAGGAGCTCTTTTAGGGCAGGCCTGGTGGCGACAAA
ATCTCTCAGCATTTGCTTGTCTGTAAAGGATTTTATTTCTCCTTCACTTATGAAGCTTAG
TTTGTCTGGATATGAAATTCTGGGTTGAAAATTCTTTTCTTTAAGAATGTTGAATATTGG
CCCCCACTCTCTTCTGGCTTGTAGAGTTTCTGCCGAGAGGTCTGCTGTTAGTCTGATGGG
CTTCCCTTTGTGGGTAACCCGACCTTTCTCTCTGGCTGCGCTTAACATTTTTTCCTTCAT
TTCAACTTTGGTAAATCTGACAATTATGTGTCTTGGAGTTGCTCTTCTCAAGGAGTATCT
TTGTGGCGTTCTCTGTATTTCCTGAATCTGAATGTTGGCCTGCCTTTCTAGATTGGGGAA
GTTCTCCTGGATAATATCCTGCAGAGTGTTTTCCAACTTGGTTCCATTCTCCCTGTCACT
TTCAGGTACACCAATCAGACGTAGATTTGGTGTTTTCACATAGTCCCATATTTCTTGGAG
GCTTTGTTCGTTTCTTTTTATTCTTTTTTCTCTAAACTTCCCTTCTCGCTTCATTTCATT
CATTTCATCTTCCATCACTGATACCCTTTCTTCCAGTTGATCACATCAGCTCCTGAGGCT
TCTGAATTCTTCACGTAGTTCTCGAGCCTTGGCTTTCAGCTCCATCAGCTCCTTTAAGCA
CTTCTCTGTATTGGTTATTCTAGTTATACTTTCGTCTAAATTTTTTCAAAGTTTTCAAC
TTCTTTGCCTTTGGTTTGAATTTCCTCCTGTAGCTCGGAGTAGTTTGATCGTCTGAAGCC
TTCTTCTCTCAACTCGTCAAAGTCATTCTCCGTCCTGCTTTGTTCCGTTGCTGGTGAGGA
GCTGCGTTCCTTTGGAGGAGGAGAGGTGCTCTGCCTTTTAGAGTTTCCAGTTTTTCTGCT
CTGTTTTTTCCCCATCTTTGTGGTTTTACCTACTTTTGGTCTTTGATGATGGTGATGTAC
AGATGGGTTTTTGGTGTGGGTGTCCTTTCTGTTTGTTAGTTTTCCTTCTAACAGACAGGA
CCCTCAGCTGCAGGTCTGTTGGAGTTTGCTAGAGGTCCACTCCAGACCCTGTTTGCCTGG
GTACCAGCAGCGGTGGCTGCAGAACAGCGGATTTTTGTGAACCGCGAATGCTGCTGTCTG
ATCATTTCTCTGGAAGTTTTGTCTCAGAGGAGTACCCGGCCGTGTGAGGTGTCAGTCTGC
CCCTACTGGGGGGTGCCTCCCAGTTAGGCTGCTCGGGGGTCAGGGGTCAGGGACCCACTT
GAGGAGGCAGTCTGCCTGTTCTCAGATCTCCAGCTGGGTGCTGGGAGAACCACTGCTCTC
TTCAAAGCTGTCAGACAGGGACATCTAAGTCTGCAGAGGTTACTGCTGTCTTTTTGTTTG
TCTGTGCCCTGCCCCCAGAGGTGGAGCCTACAGAGGCAGGCAGGCCTCCTTGAGCTGTGG
TGGGCTCCACCCAGTTGGAGCTTCTCGGCTGCTTTGTTTACCTAAGCAAGCCTGGGCAAT
GGTGGGTGCCCCTCCCCCAGCCTCCCTGCTGCCTTGCAGTTTGATCTCAGACTGCTGTGC
TAGCAATCAGCGAGACTCCGTGGGTGTAGGACCCTCCGAGCCAGGTGCGGGATATAATCT
CCTGGTGCGCCATTTTTTAAGCCCGTCGGAAAAGCGCAGTATTGGGGTGGGAGTGACCCG
ATTTTCCAGGTGCCGTCTCTCACCCCTTTCTTTGACTAGGAAAGGGAACTCCCTGACCCC
TTGTGCTTCCCGAGTGAGGCAATGCCTCACCCTGCTTCGGCTCATGCACGGTGCGCTGCA
CCCACTGTCCTGCATCCACTGTCTGGCACTCCCTAGTGAGATGAACCCGTTACCTCAGAT
GGAAATGCAGAAATCACCCATCTTCTGCGTCGCTCACGCTGGGAGCTGTAGACTGGAGCT
GTTCCTATTCGGCCATCTTGGCTCCAGCCTGACTGCATTTTCCTTCTTGTTGTAAATAAT
AAAAAATATTTATAGGGACAATGCTTAGGGGTACAGCTTTGTCTCTGTCTTGTAGGTTTTA
ATATGTGGCATTTCAATTTTTAATATTTTCTAAATGTCTTTTGTATTCTTATTTTCCCTT
CCTCTTTGGTTCAGTTTCTTGCAGATTCTTCTTTAAGGATGTTTATAGTAACATTTGTGG
TATCTGACTTGGCAAGTTGCAAGTATTGTACTACATTTCCCACATTAGTTACCCTTGTAG
CTGTACTTTTCCTTTCAGATCCTCTAGTAATTCAAAGAGACCCACTCAGGTTCAGGCAAA
TATAAGAAGCTTCTTGTGAATGGAATGGCTTATCTAATATTTCTAAAATGACTGGAGCAA
TGACTTACTGTTTCTAAGGCTTGAGGGACTTGGGCGCAGAGGCAAAAAATCACTCCCGCT
AGAGGTATGATGGTGAAAGCTGGCTAGCAGCTGTTTGTACCTCTGGTGGGAGTAGGACT
GGGGACTCCCAGACCTTGCAGGCACTTATTAGGGAATACAACATCATCAGGAAAGGGACT
ATGTGAACAAGGTTGGATGCTCCAAGGAAAAATGGATTGATGACCCTGGGAGGCTTTCCT |

TABLE 17-continued

SEQUENCES

| SEQ ID NO: Human Allele | Nucleotide/Amino Acid Sequence |
|---|---|
| | CCTGGAATCTGGGCAATGCCCACTCTCGTCATGCTTCTTTAGAACATGTTCTTATTTTCA
AATGTTTTCATAGATTTTAAATGGGAATTTGGGAAGGCAGTCTCCAGTCACTTCCACCCT
ACCTTTTTCCTGGAAGTGTTCTCTAAATCATGTACACATCTATTCTCCTTTACTTGGCTC
TAGTGGTTTCTGGGACACCGGTTAGTGGTCAGACTTTGAAAACTGCCCTTTCTTTGACTA
CAAGGTCTGGTTTGGTCTATATGTCTCTGGAGAATTCTTCTCCCTTCTAGGTGGTGTCTT
TGTAGGGACTGTCTGTCTCTGTTGCTGGGTGGAACCTGGAACCTGGTTAAGGCTGGCCAG
TGGAGGGGCTGTGCCTTGAGGAGGGCACAGATAGCCCCAGGAATAGGTGCCATCCTGGCA
ATGTCCTTGGGGAATGTGGTCTCCCCTTTGGAGATTTGGCTGTTGCATGAGGTGCTAACT
GAGTGCAGGGGTTGCTACTCGTTGCTTACTGCAGCTTCCCTGGAAGCCTTTGATGAGGAG
GGCAGGACCTATGGAGGAGACAGATCAGGAGAGTGCATTGTTTCCACAGCTGCGGTTTGC
TCTGCCTAGCCCTTGTGGTGAGATGCAAGGAGCCTTCTTTCTCTATTATGGGAAGGTAAT
TTGCTCTGAGGCCATTTTCACTATTAAAATACCCATAAGGCAGGGAGGAAAACCCCTCTT
TAAGCAGAGAGGCAGGAGTCAAGTGTGGGGAAAGCTGTTGCTCTCCCCTGGAAGTTTTGG
ATGAACAGTGGATACGTGAATGTGGGGTGGGAGGAGGCTGTTAAAAATGTCTTCATACAA
GGAGGCATGTAATTTCCTCCTGGTGGGCATGGTTTTACTCCACATCAGATGTCATTTTGA
TCTGCCTGTCCCATCAATGGTCAGGCTTCAGCTGGAAAAGAGAGAATGGTGGAAGTAAGA
GGTGGGAGACTAGAATGTCAGGCAGAAACAGCAGCGACAGTCTGCTGTCTCATTTGCTTA
AGATCTGTATGAAGACTTGAAAAATCCCACAAATCTGCAATTGCAGATTTTTATCAAAGC
ATCTATAACTTTATAATTTAAAACTGGTATTAAAAGATGTTGCCTTTTTAAACTCTTTTA
ATGCCTGTTTATATGAGGACATTTTTAACAACCTCCTGCAACCCTACATTCACACACACA
TATTTTAGGACAGACATTATTTAATCTGATATGCTCATTTGTCACACAAAAGGTGAGCAG
CTCAGAAAAAGCCTGAAGCAAGGAGGAGCTCTTGCCTGTAGCAGCCTCATGACCATTTCT
GCTCTTGGACTTGGCTGCTTTGAGTTTTTTCAAGTCCTCAAGGCCTTTGTTCTTTAGCTT
TCAGGGCTATTATGACTGGATAGTTTACCAGAAAAGGTCCACTTCTTTTACTCTGAACTG
ATAAGCTGTTTAACTGAATTGCTTGTTTCTGTCCCAAGTGAGCGTGTGTATGTGTTTGTG
CTTGCAGACTCAGTATTTTTGCAGCTTGGGATTATAACAAAAGATACGAGATTTTTTTTT
TGAGACAGCAGATAAAAAGGGAAATAAATTAGAGAATTATCTTAGTCAATTTTATGTTGT
GATAACAAAATACCACAGACTGGATAATTTGTAAAGAATACAGATGTATTTCTTACAGTT
CTGGAGACTGGGAAGTCCAAGATCAAAGGGTCTGTATCTGGTGAGGGTCTTCTTGCTGCA
TCATCCCATGGCAGAAGGCAGAAGGGCAAAAATGTGCACATGAGAGAGCAAGGGTAAAGA
GGCCTGAACTCACCTTTTATCAGGAACCCACTCCTGAGATATTGGCATTAATACATCACA
AAGGAAGTGTCTTCATGGCTTAATCACCTCCTAAGGGTCCCACCTCTTAATACCATAATA
ATGCCAATTAAATTTCAACATGACTTTTGGAGGGAACATTCAAACCATAGCAAGGATAGA
ATATGATGGAAGATTCAGGGAAGAGAAAGGAAGGGCCCAGTTTTTATTAAAATTGTGACA
AAGTACACATAACATAAAAGATACCGTCTTAACTATTTTAAGTTTATTGGAATTAAGTGC
ATTCACAGTGCTGCACAACATTATCATTATTCATCTCCAGAACTCTTTTCATCTTGCAAA
ACTGAAAGTCTATATCCATGAAATACCAACTCCCCATTTCAATCTTCCCCTCAGCCCCTG
CCTCATATAAGTGGATCACACAGTATTTGTCTTTTTATGACTGGATTGTTTCACCTTGCA
TAATGATTTCAAGGTTTATACATGTTGTAGAATGTGGCAAAATTTTCTTCCTTTTTCAGG
CTGATTAATATTCCATCACATGTATATACCACATTTTACTCTGAACTGACAGGTTGTTTG
ACTGAATTACTTGTTTCAGTCCCAAACATGTGTGTGTGTGTGTGTGTGTGTGTGTGTGTG
TGTGTGCGTGCACAGACCCAGTATTTTTGACAGTGTGGGAATATAAAAAAGATGTAAGCT
ATTTTCTTTTTTAGGAGATTGTCTACTTATCTGGCAAAGGGCATTTGGGTTGCTTCCAC
CTCTTTGTTATTATGAACAGTGCTGCTATGATCATGGGTAGGCAAATAAGTTCTTGAGAA
CCTGCTTTCAATTCTTTTATACATATACCTAGAAGTGGCTTTGCTGGATCATATAGCAGG
TCTATTTTTAATTTTGAGGAGTCTTCATACTGTTTTCCATAGGGATTGCACCATTTTAC
AATCTCATCAACAGTGCACAAGTGTTCCCATTTCTTCACATCTTCATCAACACTTGTTAT
TTTAGGTTTTTTAAAAAATAGTAGCCATCCTAATGGGCATGAGGTCATCTCTTTGTGGTT
TTGGTTTGCATTTTTCTAATGGTTAGTGATGTTGAGCATCTTTTCATATGCTCGTTGGCC
ATTTGTATTTCATCTTTGGAGAAATATCTATTCAAATCCTTTGGTCATTTTTTAATTAGG
TCATTTAATTTTTTATTGTTGAGTTGTAGGAGTTCTATTTTATTTTATTATTTAATTTAA
TTTTATTTTACTGTAAGTTCTGGGATACAGGTGCAGAACATGAGGTTTGTTACATAGCT
GTATGTGTGCCATGGTGGTTTGCTTCTCCATCAACCTGTTATCTAGGTTTTAAGCCCCAC
ATGCATTAGGTATTTGTCCTAATCCTCTCCCTCCCCTTGCTCCCACCCCCAACAGGCCC
CAGTGTGTGTTGTTCCCCTCCCTGTGTCCATGTGTTCTTATTGTTCAACTCACACTTAGA
GTGAGAACATGCAGTGTTTGGTTTTCTGTTGTCAGAGTTATTTACATATTCTGGATGTTA
ACCCCTTGTTAGGTATATGACTTTCAAATTTTTCTTCTATGAGTTTTATGTTTTTCAGGT
CTTACATTTAGGACTTTAATCCATATTGAGTTAATTTTTTATATGGTGTAAGTAAAGATT
CTAACTTCATTTTTTGCAAGTGGAGATTCAGTTTTCCCTTTACCATTTGTTGAAAAGACT
GTCCTTTTTCCAAGGACATTGCCAAGACTATTCCATAGTCTTGTCACCCTTGTGGAAAAT
AATTTGGCCATATATGCAAAAGTTTACTTCTGGGCTCTCTATTCTATTCCGTTGGTCTAT
ATGTGTCTTTATGCTAGTACCACCTTGATATGGTTTGTCTGTGTCCCCACCCAAATCTCA
TCATGAATTGTAGTACCCATAATCCTAACGTGTGGTAGAGGGCCCTGGTGGGAGATAATT
GAGTCACGGCGAGGGTTTCCCCCATGCTATTCTCGTAATAGTGAGTTCTCATGAGATCTG
ATAGTTTCATTAGGGGCTTTCCCCTTCGCTTCACTCTCATTCTTCTCCTTCCTGCTGCCG
TATGAAGAAGGACATGTTTGCTTCCCCTTCCACCATAATGGTAATTTTTCTGAGGCCTCC
CCAGCCATGCTGAACTGAACTGTGAGTCAATTAAATCTCTTTCCATGATAAATTACCCTA
TTTTGATTACTGTAGCTTTGTAATAAATTTCGATATCAGGAAGTGTGAGACCTCACAATT
TGTTTTTTTCAAGATTGTTCTGGCTATTTGGGGTCACTTGAAATTCTGAAATATGAATTTA
GAATGGATTTTATATTTTTGTAAAAAATGTCATTGGGAGTTTGATAAGGATTGCACTGA
ATCTGTAGATCACCCTGGGTAGTACGATATCTTAACAATATTAAACCTTCCAATCCATGA
ACACAGGTATGAAAAATTCAGCTATTTGCTTGTCATTTACTCTCTTCATTGTTCTGTCA
CCATTGTCTCCTTCTGTACATCAGAGTGACAGCTCTAGAATGGTGGTGACAAAGTACAAC
CTCCAGTGCTTGGGTCTCATGTTACCTGAAACTATTCTCAAGAATATGGACATAAAGCTA |

TABLE 17-continued

SEQUENCES

| SEQ ID NO: Human Allele | Nucleotide/Amino Acid Sequence |
|---|---|
| | GGCCTTGAAATGCAGCTTCACAATTTATCTCTGGGCCTGTTTCTCTGAAATTCTAAATAC |
| | CAGGACTTGCTTAAAAAGCTTGCATTTTTGAACTCTGGTTTGCTGAAGACCAGAATGTTA |
| | AATGTCACATTGAAATGGAAAAAAAAATCAAGGCCAGTAAGATAGAAGGGCTCTTTGCTT |
| | TTCACATTGTTTATCATGTTTCTTCCTGTTGTAAATGATTTGCTTTTTAGGTGTGTCTTC |
| | ACTGGGATTATATTTTTGAAGCTTTGATTAAAATATTGGCAAGAGGTTTCATTCTGGAT |
| | GAGTTTTCTTTCCTTCGAGATCCATGGAACTGGCTGGACTCCATTGTCATTGGAATAGCG |
| | TAAGAATATTAAAGATGTTTTTGAAGAGACTTGGAGTGGGAAAGAAGCCCCTTTGCTTCC |
| | ATCAGAGCTCTGTGTGGATCCATTTGAGTGGCTGAGTATGGCCTAGTAATGCCTAGAGCT |
| | CTGAGTGCTGTGTTGGTTGGCCCTGAACAGCACGTGCAGCCAATTGGCCAGAGGCCCCCA |
| | CACACAAAGCCATTTCTAGGTCAACACTCAAGTTCGTGTTCCTTCAGCCATTTACTCACC |
| | AACACTGGCCTGTTATGGGCCAGGCTCTATGGAAGATACAGGGGTGTGCCAATGAAATTA |
| | AAAAAAAAAAAAAAGACATGGTTTTCAATCTTATGAAGCTCACAGTCCAGAGGGGAAAAG |
| | TAACAATTAATGGCCCTGAAAATATGGTATGATGAGTACCAGGATAGGGCTATACATGT |
| | ATTAAGCTGTCAGAGAATATAGGAAGAACAAAGCAGTCTAAAAAATCTTTGGCTGCTACA |
| | AGGTTACAAAGAGCTTTACTCCTGTTTACTTCTAGAAGTTCTGTAGTTTTGGCTTTTATG |
| | TTTCAGTCCATGGTCCATTTTGAGTTAATTATCATGTATGGTGTAAGGTGAAGGTTGAAG |
| | CTCTTCCTGAAGGAAAGACACTGATTTGGAATCTGAATGATGAAATGGAGTCAGCAAAAG |
| | AAAAAATAAGAAATGCAGTGACACATTGCCAGCACAACAATAGTAAACCTGGCATCATTC |
| | AATATGTACCAGGCATTATGTTAAGCACTTTGCATATTTTTTCCTATTTAATATTCACAA |
| | AAGCCCTTGGAGGTAGGTGCTAGTAATTTCAGAGTTTTACATTTGAAGTTCAAAGATTGT |
| | GTGCTCTTCGTTATTGAAAGGTGGTGAAGCACAGTGGTTTAGAGTATGGCTCTGGAGCTA |
| | CACTGCCTGGCTACACATTCAGGCTTGACCATGTAGTGGCAGGAGACTTTAGTGAAGTGC |
| | CTTGGGGCATGGAACTTGTCAGCCACTCAGTAAATATTTGAGAGGACTTCTATTATTCAT |
| | GGATGTAGCCACAACTACATGAACTATTTCAAGGAGTCTTCATCTGTGTCCACGTATGAA |
| | GGTGAACTGAGAACAGCGTCCTCTGCAGTTCATAGCAAGAACAGTGGTATTGCCAGATCC |
| | TAAGATAAAGGTGGGGCTGGAAAGGTGAGGCTGTCGATTTCACCTTGGAGGTCACAGGCC |
| | TCAGGCTGAGCTTACTTGTGGCTTTTGTGGAGATGTGCAGTGCAGCTGCAGGACTGAGCA |
| | AGCCCATGCCTTCCCTGTGCTTTGTCTTGTAGGATTGTGTCATATATTCCAGGAATCACC |
| | ATCAAACTATTGCCCTGCGTACCTTCCGTGTGTTCAGAGCTTTGAAAGCAATTTCAGTA |
| | GTTTCACGTAAGTCACTCTCACTTTCCACACTGGCTCCTATCTAGAAAGAATGTTAATTT |
| | ATATTTAAATTTTTTCAAAATGTCATCATGTAAACCAAAACAAACAAAGCCTGCTTTAC |
| | AAATTTATTTGATGGTCCAACTGATAATTATTGAGCACCTAATATGTCCAGGCACTGTGC |
| | TAACTGCTTGAGATCTAGTAGTAAGCAAATGGATACGGACTCATGGAGTTTTACCTTCTA |
| | TGGTGGGGTGGGGAGACAGACACGAAGCAACAACTATAATAAATAAGTACATTATGTAG |
| | CATGTGAGCAAGTGCTATGTGCCAGGGAAAATATAAAGAAAAAGTAGACACCATGAGGGC |
| | TATGGGAAGTCACAGGGTACAGGGGAAGGAGGTTGCAGTTTTAAACAGAGTGATCACGAT |
| | AGTTGTCATTGAGGTGAGAGGTGGCAGAGATTTGAAGGTGGCAAGGGAGTGACACAAGCA |
| | GATATATGGGAAAGAGTATTCTGAGCATGGGAAACAGCCAGCACAGAGATTGAGGAGTAG |
| | CAAGGATGAGGATGGGACTGGAAAGGAGAGGGTGAGAGGCCAGGTAGAGGTGGGATCATA |
| | GAAGTGAAGGGGGGCCGGGTACAGTTGCTCACGCCAGTAATTCTAGCACTTTGGGAGGC |
| | CAAGGTGGGGAGATAACTTGAGGCCAGGAGTTTCAGAACAGCCTGGCCAATATGGAAAAG |
| | CCTCGTCTCTACAAAAATACAAGAGTTAAGGCCAGGTGCAGTGGCTCACTCCTGTAATCC |
| | CAACACTTTGGAAGGCTGAGGCAGGTGGATCACCTGAGGTCAGAAGTTTGGTATCAGCCT |
| | GATCAACATGGAGAAACCCATCTCTACTAAAAATACAAAAGTAATCAGGTGTGGTGGTG |
| | CATGCCTGTAATCCCAGCTACTCAGGAGGCTGAGGTGGGAGAATCACTTGAACCTGGGAG |
| | AGGGAGGTTGCGGTGAGCCTGGATCGCCCCATTGCACTCCAGCCTGGGCAACAAAAGCAA |
| | AACTGTCTCAGAAAAAAAAAAAATTAGTTAGATGTGGTGGTGAGTACCTTTAATCTCAGC |
| | TACTCGAGAAGCTGAGGCAGGAGAATTGCTTGAACCTGGGAGGCAGAGGCTGCAGGCTGC |
| | AGTGAGCCAAGATTGTGCCATTGCACTCCAGCCTAAGGTCTAAAAAAAAAAAAGGACTGA |
| | AGGGGAGTCTTGTAGGCACAGGGAGGATATGCGCTTCACTCTGAAGAAATGGGAGCTGTT |
| | GTGTGGAGAATGGAATGTAGGGGAGATGGGAGAAGCAGGAAGACCTCCTGCTACAGGGAG |
| | CACAGTGGACTAAAGATCCCGGCTTCCACCTCTCTGGATTCCCCACTGCATTCATCCACA |
| | TGCCAAGATCATGCCTGCCCTGCACAGTGTGTGTGGGTTCTAGTGCTGGCCCATTCCTGA |
| | AGCATATGGGATTCTTCTAATAGGAAACTTTGGCTCAGGGACTCTCCAGTGACCTGGCTG |
| | AGACTCCGACAGCTGCACTGCAGTCTGAGGTTCTTCCTATCCAATCCTCCTCCCTTGTCT |
| | GTCTCTCAGACATCAAACTTGAGCTGCAGTCTGAAGTTTCTCCCTGCCCACTCCTGCTCC |
| | CCCGACTCATCTTTCACAGGCGTCCTCCCAACCCCCACAAATCTCTGGCACATCTGATCT |
| | CAGAATGTCTGCTCCTCAAAACCCAAACTGACACAAGAGACCATAATCCAAGCAAGGGAT |
| | GGCAGTGCTCTCTGATCAGGTAGTGGTAGTGGAGTTGGTAGACACTGGTTTGATTCTGTG |
| | TCAATTCAAAGGTAGAAACAATAGCATTTCCTGACTGATCAATTGTATACATGGTGTGAG |
| | CAAAAGAGAGGAGTCAAAAATGACTTTTATACCTGATGTCACTGATTGAGACAGAGAAGG |
| | CTGTGAGAGGAGCAGGCCTTGGGGTCAGATTACAAGCTAGCTTTGAACATGTTATGTTTG |
| | AGATGGCTGTGAGACCACCAAGGGAAAGGATTCAGCAGGAAATTAGGTATATATGAGTCC |
| | AGGAGTCCAGGGAGAAGTCAGAGCTAGAGATACCATTTCAGGAATCAAGGGTCTATAGAT |
| | ATTTAAAGCCGTGAGATCTAAAGAGATCACCAAGGGAATAAGCACTGATGGAGAATAGAA |
| | GAGGACCAAGGTCTGAGCCCCAGGGTACTGAAACATGAAAGGGAGAAGAGGGAGAAACCAG |
| | GGAAGGAGATGAGCAGCAGCCACCTGTGAAGTAGGAGGGGAACCAAAGGTGGTCTCCTGG |
| | AAGCCAGGTGAGGAAGTCATGTTAGCCCTTCGGATCAGGATGAAGCCAAGGTTGGGTGTG |
| | AATATGAATTTCTGTTTATTAAAAATGAGGTTATTATAGCACACCCTTTTCCTCTCCTTC |
| | CCCTTTCCTCTCTTTTCTTTACTAAAACAAACAAACAAACAGTTTATTATCTTCCCTCT |
| | CTGGACTCCTTTCCCCCCACCTTCTCCCCTTCCCTCTTTTCTCTTCTATCAGTGGCTTT |
| | GGCAAACTGTAAAAAGACATGGGAACTATTTAGTTGTGCTGATGATATAGACATAAACTA |
| | TACCGCATGGCCCCAATACCTAAACTCCAGTCCTTTCAAACAGAAGCAGTAGGTTATTTT |
| | TTGAAACTTCAGAAAAGCAACTGAATAGTGATAAAGAAACTGGTAGTCAGAGGACACTTT |

TABLE 17-continued

SEQUENCES

| SEQ ID NO: Human Allele | Nucleotide/Amino Acid Sequence |
|---|---|
| | ATATACAATTTATCTCTTCTTCTCCTCCTCCTCCTCCTCCTCCTTCTCCTTCTTCTTTTC
AAGTAGGACTTTGTTTTCCCAGGTAGATTTAGGAGCTTTCTGCATGAGCTGAGCCCCTTT
TATTTTCACATAAGTAAATACACATTCAGGCAGTCATTTAGCAGCTTTCATGTCCCCGTC
TTCATCTCCACACAGGTGAATATAGTCTCTATTTTGGCCCATTAAATGCACTGAGATGCC
TGGATGCTTTTTGGAAGTAAGGGTGTGAGGCACAATCTTTTATGAGACTATTAAAAAATG
ATCCAGGAATCACAATCATCACTCATCCACATTTCTTGCTTTGGAGAAGCCTCTTGTTAT
AGATTAAAATCTGCCTTGGGTGACACTGTAGTAACCTCTGGTTTGCCTTCAATTGGTGAT
ATAGTAAGTGTCCCAGCTTGGCCTCCAGGTTCCTGCTATCTGGTGTTATACTTTGTGGGA
AGCCCATCCACTGAGGGCTTGGCCTCCCACTGTATGCTGCCATGTGCTCTCACCTCTATG
CTAATCAATTGAAATTTTGTCACTTAGTGTCATTCCATGCCTTTCAATTACATCTGGGAG
TTTATCTCTCCAGCTATCTTGAGACTCAGTGGATTGCTGAAGTTGACTTGTTCTTTTTCC
AGCTCTGTCCAGTGACATCATATTGGTAGCTTGAAATCTACCATGGTGGTGAGTGGGGAT
CAGGATCTATACCACAGAATTCAGAAAACAAGGAAACCTGTAAATGCTATAGATCAGGGC
TCTCCTGCCTCCTGCTTGAAGAGCCAGTTTTAAATATTTACTAGCATGCCACAAGATTAT
TTATTTTGTAACTTTGGCAGCTTAACAGTGTGCCATGGACATAGTAGGTGCTTAATAAAT
ACTTCTTGAATGAATGAATGAAAAGAAAACACCCTATTCTAACTGGTAATCTGAGT
TTTCCCTCCCAGGATATCCTCATAATTTGGGTCTAGACAAATCTCCTTCATCCCCTATAC
CCCACAATTTAGCTGTGTCTCATGGTACTCAAGTACTTTGACAGTAGACAGTATCTACTA
AATGTTAAATACAGGTCTATCTCATTCTCTAGTGTGGCCCCAGCTTAGGTGGTGCCTTTG
CAACTGTCCTCAACCTATGCCTTGAGTCCGTGTGGCATGTTTCTATTCAAAGCCTCTTTG
CTTGCTCCTCATAGCAGCACTGAGGCAGGCATAGGGCAGGAATAGAGAGATTGAGTCTCA
AACTTGTTGACTGCTTTGATGACACTCAGCTTCCAAGGCACAGAGTTGGAGCACAAACTC
AAGGCATCAGAATCATAGGCTAGGCTGGAGTCCAGTTCCAGCCTGCAATTTGACAGTTTC
CGAGACTTCAGTTGCTCCTTACTTGGCCTTTGTGAGTGTCTGGCTGAGGGGGATGGGCTT
CTCCCCAAGCCTGTCCTCTTTCTCAGGTCTGAAGGTCATCGTGGGGCCTTGCTACGCTC
TGTGAAGAAGCTGGTCAACGTGATTATCCTCACCTTCTTTTGCCTCAGCATCTTTGCCCT
GGTAGGTCAGCAGCTCTTCATGGGAAGTCTGAACCTGAAATGCATCTCGAGGGACTGTAA
AAATATCAGTAACCCGGAAGCTTATGGTAAATACCCAACCTTTCTTTCACTCCTTGGTTT
TTGCATGGTTAACTTTTCCTTATCCTCACTTGTCCTGCCTTCACACTTCCCTTACAGAGT
CTCTTAGCAGCAAGGGAGGACTTCATCCATCCAGGGTGCTCCTGTGGGCAGATGCATTTC
CTAGAGAATTGCCTCATTCTTTGGCTTCCTATGGAGAAGGAAAGTCTTGAAACCACATCC
ACAAGAGCAATTCTATGCTGTCCCATCCCTTTGCCATTTAGATCTCTGCCCACTTCTTTG
TAATGATTTGCAGAAGTTTTTAGAATGCTTGGATTTGGCTAACAATAATCAGCAGCTTCC
CAGCCCCACTCCTCAAGTATTTCTCCAATGACACGTCTTTTTTTTTTTTTTTTTGAG
ATGGAGTCTAGCTCTGTCACCAGGCCGGAGTGCAGTGACATCACCCCACTGCAACCTCTG
CCTCCCAGGTTCAAGTGATTCTCCTGCCTCAGCCTCTCAAGTAGCTGGGATTACAGGCAT
GTGCCGCCACACCCAGCTAATTTTTGTATTTTTAGTAGAGACGAGGTTTCACCATGTTGG
CCAGGATGATCTCCATCTCCTGACCTCGTGATCTGCCCACCTCAGCCTCCCAAAGTGCTG
GGATTACAGGCGTGAGCCACCATGCCCGGCCAACAACACTTCTTTCAGTGCCCACCCTCT
CCATGCTGAGGTTGACCCTACACCTACTCCATGTGTCATGAATCTCATGTGACTACACTC
TCTTGATGTCTCTCATGGGATGGGTCTGTGTCCAGCTTCCCCCAGGGAGGATCTTCGGTT
CAGTATTATTTAAGAGAGGCAAAGTGGTGGTGGTGATGTCACTGCTTCCTCCTCCAACTT
CTCCTTCCTTCTTCTTTTTCCCCTCCTTCCTTCTTACTCCTTCCAGAGGTCTTGGGCTCCAG
TTTCTCTCTGGACACACCTCCTTTAATCATTTTAGAAGATGTAGAAACATCCATTTTCTG
GCATAATCTGCATACTTACTATTCTCTTTCCTTTCAATGTTTTTTTTAAAATCTGAATTT
ATGACTTTTTCCTCTCTCAGACCATTGCTTTGAAAAGAAAGAAAATTCACCTGAATTCAA
AATGTGTGGCATCTGGATGGGTAACAGGTAAGAGGTTTATAATCATTTTCCTCCCAAGAA
GAGTACCTCTAGACCTTTTAGAATGGTGTGGCAAACAGTCTTTAATGACTGGTGGACACA
GTGATGATAGTTCTCACATAATTATTTCATGTGTCTAAACATGTTTAGACTTGTGTTATT
AAATTAAAAAATCATTTCCTGGTGTTTAAGGCAGCTTTCCTCCCTAGTTATGTTAAATTG
GAAGCTTATAAGAAACCTACTGAAACAGTGATATTTCAACTTTATGGAGTAGGTATTCAA
GACTTTCAAAACTGAGAAGGGATGTTATGACTGAGAGCCCTGTGAGGCCCTTGTTTCCTG
TTCAGTGGCATTGCCCTGCTGCAAGAGTATCTGAGCATGCTTCTTCTCTTTGTTGACCTG
TTGACAACTATTGCCTCAAATTACAAACACAGTTGAACATACATCCACTTACACTTGCCC
CAACAGCTGCTGGCCCTCTGCTCCAATGGGGAAACTCTTTTTTCCTTCAGGTTAGCGGTG
CTTTCTATTGTGAAAGATTCAATTCAGTGAAGATTTATTGAGTGTATTTCAAATTAAGAT
AATATGCAAGGTACTCTGATGAAATAGATGACATTCATTCCTAAATTACAAATAGATAAC
AAGAATCTACAGAGTGCCAAGCCCTGAGTTTGCCTCAAGGAATGCAATTGTGAACAAGGC
AGCTCCACGTTTTTGGATTTGATGTCTTCTAGGGAAGACAGATGCACAGAAAATGCAGTT
ATGTGTTGCATAATGATATTTAGATTGATAATGGATGATATATATGATACTGGCCCCATA
AAATTATAATCTATATTTTTACAGTGCCTTTTCTGTGTATACACAAATTATTACCATTG
TGCTACAGTTGCCTACAGTATTCAGTATAGTAACATGCTGTACAAGTTTGTAGCCTAGGA
ACAATAGGCTATGCCACATAGTCTAGGTGTGTAGTAGGCTATACCATCTAGGCTTGTGTG
TACACTCTATGATGTTTATACAACAAAATTGCCTAACTACACATTTCTTAGAATGTATTC
CTGCTGTTGAGCAATGCATGATTACTAGAAAGTGTGATGAGTGTTATAAGGGTGATGTGC
AGGTGCTGAGAGGTATGATGGGGTTGTGACCTTGTCTGGAGAATTAGGGAAGGCTTCTCT
CATTCCATTTGCAAGACACGATAGGCTTTAATCTAATATGAAGCTTACTGAGCTTTCTAG
AATGATTCCCAACAGCACACACTGCATTGATATTGTTGAGGATCATTCTAGAAAGAAAAA
CTGTCTTCCATGAAACCGGTCCCTGTTGCCAGAAAGCTCCCCAACATTTTGGCACCAGGG
ACTGATTTCATGGAAGATAATTTTTTCGTGGGCAGGAAGTGGGGGTGGTTTTAGAATGAA
ACTGTTCTACCTCAGATCATCAGGCATTAGTTAGATTCTCATAAGGAGCGTGCAACCTAG
ATCCCTTGCATGCGCAGTTCACAATAGGGTTCACACTCTTTATGAAAATCTAATGCTTACC
ACTGATGTGACAGGAGGTGGAGATCAGGTGTAATGCTCACTCGCCTGCTGCTCACTTGCT
GTACAGCCTAGTTCCTAGCAGGCCATGAACCAGTACTGCTCTGGGGCCCGGGTTTGGGGA |

TABLE 17-continued

SEQUENCES

| SEQ ID NO: Human Allele | Nucleotide/Amino Acid Sequence |
|---|---|
| | TCCCTGTCTTAAAGGGAGCCCGACAGCTGCTGCATATAGCACTTCTTTTACCCCTCACAC |
| | AGGCAGACAGGTGTGGTTACCATAGGCAGAATCCAACGTGGGGTGTATAACCTAGACAGG |
| | CAGAAGCAGCAGCCTTGTTTCCAACTAGTCCTTTTTTTTTTTCCCAAGTCTTTTGCCTCC |
| | AAAATCTCTTATTACAATACTATACTGCTATAAAAAGTCCAAAAAACTATTTTAGCTGTT |
| | GAAAACTCAAATAACATCAGACACAAAATGAATCAAGTGTGATGTGTATATGACAATAGA |
| | GAGTGGTGGGGAAAGTAGAGAGGCAGAGGACACATACCATGCTTAACAGCAGTCAAACTT |
| | GGGTATTTTTTTTATTTCAGTAGGTTTTGGGGGAACAGGTGGTACTTGGTTACATGAATA |
| | AGTTCTTTAGTGGTAATTTCTGAGATTTTGGTGCACAAACTGGTCTTCTTTTTAGCTTTT |
| | ATTTTAAGTTCAGGGGTACATATGCAGGTTTGTTATATAGGTAAATTTGTGTACAGATTA |
| | TTTCATCACCCAGGTATTAAATCTAGTACCCATTAGTTATTTTTCCTGATTCTCTTCCTT |
| | CTCTCAACCTCCACCATCCAATAGGTCCCAGTATCTATTGTTCTCCACTGTGTGTCCATG |
| | TGTTCTCATCATTTATCTCTCATTTACAACTAAGAACATGTAGGATTTGGTTTTTCTGTT |
| | CTTGCATTAGTTTGTTAAGGTTAATAGCCTCCAGCTCCATCCATGTTCTTGCAAAGTAAT |
| | AGAACTCATTCTTTTTATGGCTGCATAGTATTCCATGGCACATATGCACCACATTAGCTT |
| | TATCCAGTCTGTCATTGTTGGGCATTCAGGTTGCCTCCATGTCTTTGCTCTTGTGAATAG |
| | TGTGACAATGAACTTTCACTTGCATGTGTCTTTATGATACAATGATTTATATTCCTTTGG |
| | GTATATACCCAGTAATGGGCTTGCCAGGTCAAATGGTAGTTCTGTTTTTAGGTCTTTGAG |
| | GAATTGCCACAGTTTTCCACAATGGTTGAACTAATTTACACTCCCACCAACGGTGGATAA |
| | ATGTTCCTTTTTCTCCGCATCCATGCCAGCATCTGTTATTTTTTGACTTTTTAGTAATAG |
| | CCATTCTGACTGGTGTGAGATGGTATCTCATTGTGGTTTTGATTTGTATTTCTCTAATGA |
| | TCAATGATGTACAACTGGTCTTTATAGGGCTCTTGTCTCTAAGTTTATGTGCCAGCACAT |
| | CTCTCTCAGTCTAGGTACAATATGAATGCTCCAGAGTTTTGTGGTAAACCAACTCCTAGT |
| | ACACAGCATTCCACAGTGATCACAACATGCTTGCTTCTGAGGAGATGGCACTCTGAGAAG |
| | GCAGGTCTGTGATCATCTTTCCAGGCAGGCTTTGGTCTTTTCAGGGCCCAGGCTAGTCTT |
| | CACCCTCCAGTCACTGCTTCCTCCCCTGCTGACTAATTCACCGTGACTACAACTCAGATC |
| | TGAAGTCTAAGTAGGAGGTTCCAGTAGATAAAGAGTGAACAATTCCAGACAGTAGGCACA |
| | GCAAGGGTGAGCATAAGGCCTTGGAGCACAAGAGCATATAGGGATTGACAAGAAGCCCAG |
| | CAACTTTTTGGGCAGACAGGCAAGAGAGCAGGAAGGAACAGAGACAAGAGCCAACCATGA |
| | AGGACGTGATAGCTCATCAGTGCCAACGATTTTGGTCTTGATCACAAAGGAAGCAGGAGA |
| | CATGGAAAGGTTTTAGGGCAGGCAGATGACTGGGCAGATTAGACATATTTTAAAAGCCAC |
| | TATGGTTTCTGTATAGAGAATGGATGCATAGAGTAGATGAGGAAGCCAATTACAAGACTG |
| | TGGTAGAAAGAATAAGGATCATGAAGATGTACAGTGGTGATGAAGAAAGCTGGATGGATG |
| | CATTCCAGAGACGTTTAGGAGACAGAAAGACTAGGACATATCAATATTAGCCTTGAATGT |
| | CAATGGGCTAAATGCCCCACTTAAAAGGCACACAATGGCAAGCTGGATAAAAAAGCAAGA |
| | CCCAATGGTATGCTGTCTTCAAAAGACTCATCTTACATGTAATGACACACATAGGCTCAA |
| | AATAAAAGAAATGGAGGAAAATATACCAAGCAAATGGAAATCAGAAAAAAAAGCAGAAGTT |
| | GCAATCTTAATTTCAGACAAAACAGACTTTAAACCAACAAAGATAAAAAATAGATAAAGA |
| | AGGGCATTACATAATGGTAAAATGTTCAATTCAACAAGAAGACCTAACTAATCTAAAGGT |
| | ATATGCGCCCAAGACAGGAGCACCCAGATTCAAAAGGCAAGTTCTTAGAGACCTACAAAG |
| | AGACTTAGACTCCCACACAATAATAGTGGGAGACTTCAACACAGCACTGACAGTATTAGA |
| | CAGATCACTGGGGCAGAAAATTAACCAAGATATTCAGGACCTGAAGTCAACATTGGACCA |
| | AATGGACCTGTTAGACCTCTACAGAACTCTCCACCCCAAAACAACAGAATATACATTCTT |
| | CTCATCACCACATGGCCCATACTCTAAAACTGACCACATAATGGAACATAAAACAAGCTT |
| | CAGCAAATGCAAAAGAACCAAAATTTTACCAAACACACTCTCGGACCACAGCACAATAAA |
| | AATAGAAGAAAAGACTAAAAAAATCACTTAAAACCATGCAATTACATGGAAATTAAACAA |
| | CATGCCTCTGAATGACTTTTGGGTAAATAATGAAATTAAAGCAGAAATCAAGAAGTTTTT |
| | TGGAACTAATGAGAACAAAGATACAACATACCAGAATCTCTGGGACACAGCTAAGGCAGT |
| | GTTAAGAGAAAATTCATAGCACTAAACGCCCACATCAAAAACTTAGAAATAACTTAAACA |
| | ATGTCACATCACAATGGAAAGAGTTAGAGAAGCAAGAGCAAAGCTAGCAGAAGACAAAAA |
| | ATAAGGAAATCCAAATAAACACAATTAGAAATAACAAAGGGGATGTTACCACTGACCCCA |
| | CAGAAATAAAAATAACCATTAAAAACTGCTAAAAACACCTCTAAGCACACAAACTAAAAA |
| | TACCTGGACACAAACACCCTGCCAAGACTGAACTGGGAAGAAACTGATTCCCTGAATAGA |
| | CCAATAACAAGCTCCAAAATTGAATCTATAATAAATAGCCTACCAACCAAAAAAATCCTG |
| | AGACCAGATGGATCCATAGCTGAATTCTACTAGATGTACAAAGAGCAGGTACCATTCCTA |
| | CAGAAACTATTCCAAAAAATTGAGGAGCAGAGACTCCTCCCCAAATCATTCAATGAGACC |
| | ACCATCGTCCTGATACCAAAACCTGGCAGAGGCACAAAAAAAGAAAACTTTAGGTCAATA |
| | TCCTTGATGAACATTGATGCAAAAATCCTCAACAAAATACTTGCAAACCTAATCCAGCAG |
| | CACATTAAAAGCTAATCCACCACAATCAAGTAGGCTTCATCCTTGGGATGCATGGTTGG |
| | TTCAACATATGCAAATCAATAAATGTGATTCATCAGAACTAAAGTAAAAAAACACATGAA |
| | TATTTCAATAGTTGCAGAAAAGGCTTTTGATAAACTCAACATCCATTCATGTTCAAAACT |
| | CTCAATACACTAGATATTGAAGGAACATACCTCAAATAATAAGAGCCATCTATGACAAA |
| | CCTACAGCCAACATCATACTGAATGGGGAAAAGCTGGAAGCATTCTCCTTGAAAAGTAGC |
| | ACAAGACAGGATACCCTCTCTCACCACTCCTATTCAACATAGTATTGGGAGTCCTGGACA |
| | GAGCAATCAGGAAGAAAAGAAATAAAGGGCATCCAAATAGGAAGAGAAGAAGTCAAACT |
| | ATTCCTGTTTGCAGATAACATGAATCTATATCTAGAAAACCCCATAATCTCAGCTCAAA |
| | GCTCCTTCAGCTGATAAACAACTTCAGCAAAGTTTCAAGCACAAAATCAATGTACGAAA |
| | ACCACTAGCATTCCTGTATACCAACAGCCAAGCCGAGAGCCAAATCAGGAATGCAATCCT |
| | ATTTACTATTGTGACAAAATAATAAAATACATAGGAATACAGCCAACAGGGAGGTGAAAG |
| | ATCTCTACAATGAGAATTGCAAAATGCTGCTCAAAGAAATTAAAAATGACACAACAACAAT |
| | GGAAGAACATCTCATGCTCATGGATAGGAAGAATCAATATCATTAAAATGGATATACTGC |
| | CTAGAGCAATTTACAGATTCAGTGCTATTCCTATGAAATTACCAATGACATTCTTGACAG |
| | AATTTAAAAAATGCTGTTTTAAATTTATATGGAATCAAGAAAGAGCCCAAATACCCAAG |
| | GCAATCCTAAGTAAAAAGTATAAAGCTGGAGGCATCACGTTTCCCAACTTCAAAATATAC |
| | AACAGGGCTACAGTAACCAAAACAGCATGGTACTGATACAAAAACAGTCATATAGATCAA |

TABLE 17-continued

SEQUENCES

| SEQ ID NO: | Human Allele | Nucleotide/Amino Acid Sequence |
|---|---|---|
| | | TGTACAGAATAGAGAGCCCAGAAATAAGGCTGCACACCTACAACCATCTGATCTTGAACA |
| | | AAGCTGACAAAACAAGCAATGAGGAAAACACCCTATTCAATAAATGGTGCTGGAATAACT |
| | | GGCTAGCTATATGCAGAAGATTGAAACTGGACTCCTTTCTTACACCCATATACAAAAATCA |
| | | ACTCAAGATGGATTAAAGACTTAAATGTAAATCCCCAAACTATAAAAACTCTGGAAGACA |
| | | ACCTATGCAATACCATTCTGGACATAGAAATGGGCAAATATTTCATGATGAAGATGCCAA |
| | | AAGCAATCAGAATGAAACCAAAATTTGACAAATGGGATCTAACTAAACTTAAGAGCTTCT |
| | | GCACAGAAAACAAAAACAAACAAAAACCAAAAAACTATTAACAGAGTAAACAGACAACCT |
| | | ACAGAATGGGAGAAAATATTTGCAAACTATGCATCTGTTAAAGGTCTGATATTCAGCATC |
| | | TATAAGGAAATTAAATTTACAATAAGAAAACAACTCCACTGAAAAGTGGGCAAAGGACAT |
| | | GAATAGACTTTTTTTTTAAAGAAGACTTACATGCAGCCAACGAGCATATGATAAAAAGCT |
| | | CAACATCACTGACCATTAGACAAATGCAAATCAGAACCACAATAAGGTACTATTTCACAC |
| | | CAGTCAGAATGGCTATCATTAGAGTCAAAAATAACAGACGCTGGCAATGTTGTGGAGAA |
| | | AAGGGAACACATACACTGTTAGTAGAAGTGTAAATTAGTTCAACCATTATGGAAAGCAGT |
| | | GTGGCAATTCCTCAAAGACCTAAAACAGAACTACTGTTGCTGGATTCATCCCAGCAATCG |
| | | CATTACTGGGTAGGTACCCAGAGGAATATAAATCATTCTACTGTAAAGATACACACACAT |
| | | GCATGTTCATTGCAGCACTGTTCACTATAGCAAAGACATGGAAGCAACCTGAATGCCTAT |
| | | CAGTGACAAACTGGATAAAGAAATGTGGTACACATACATGATGGAATACTATGCAGCCA |
| | | TAAAAAAGCAAGAGATTATGTCTTTTGCGGGAGCATGGATGGAGTTAGAGGCCATTAGCC |
| | | TTAGCAAACTAAAGCAGGAAACAGAAAACCAAATACTGCATGTTCTCACTTGTAAGTAGG |
| | | AGTTAAATGATGAGAACTCACGGACATAGAAAAGAACAACAGCTACTGGGACCTACTTGA |
| | | GGATGAAGGGTAGGAGCAGCAAGAGGAGCAGAAAAAATAACTGTTGGGTACTAGGCTTAG |
| | | TACCTAGGTGATGAAATAATCTGTACAACAAGCCCCTGTGACATGAGTTTACCTATATAA |
| | | CAAACCTGCACATGTACGCCAGAACCTAAAATAATAGGTAAAAATAAATAAATAGAAAGA |
| | | AAAAAATTTGGAGATTGAAGAGGGGATGTTGGTGTGTATTTGTGCATACAAAGCCATGTG |
| | | TAAGAGAGTGGCGGGAAGTGCAAAGGAGAGAAAACTGTTACAGATGCTTCTCATATCAGT |
| | | GTGAGTGAGTGATAATGTCATTAGCTGAGATGGGGATGCTGGCGGAGAGGCTTAATCACC |
| | | TGTATAAGTTGATGAGAGGGTGCACCCAGAGAGGAGGAGATTGAACAAAACAGGCTTATA |
| | | TTTTGAATGGTGACCAAGAAATGAGGGAGATTAAATATGGTAGGTCCATCCTCAGCAGAC |
| | | TCCTGGAAGTTAGAGGGCACTGGGACTTCACAGAATTTCCTCCAGGTCTGGTGAGAAAGA |
| | | GGGCACAATGGATGCCCTCCTCCTCAGTCAACCTAAAGCAAAACCTACCACTCACAAATT |
| | | CCCACTCTGCCCACCAGGCAAATCCCAATCAGCTTGTCAGGTCCTCTGATTAAAACACAT |
| | | GAACAGCTCAGGCTCACCAGGCATCTGAAGAAAATCTTTGGTAAAAAGGAGGCCAAGATA |
| | | AAGCCACAGAAAATGTGGCCATGAACAAAACAAGAGAACCAGAAAGGGCTCTGAAAACTT |
| | | TGAATAGTGTCCTTGGTGAAATTAAAAGAGATATTATATACATAAAACAAAAAGCAGCTT |
| | | GTTGTGAAAAAGAACAGCAAAAAAAGAAACTTATTAGAAATTAAACATTATTACACAAA |
| | | AATCAACATTAGAACTAAAAGATAAAGTTGACGAAATAGCCCCGAAAGTAGGAAAAAGAG |
| | | AACAGAAAATTTGAGAGTAAATGTCAATTCAAAAGTCCCAACTTTTGACTAAGTAGGAAT |
| | | TCTACAACTAGAGCACTGATTAAACAAAAGGGAGGAAATTAGTGAAGAAATGATGCAGAG |
| | | AATTTACCTGGGACTAAAGATGCAAGTCCCTCAGTGCTCCAGAAAGTACCCAACACAGTG |
| | | AATGAGAAAGGACCATGCCAAGGACATTATCATGGCATTTCAGAACTTTTTGGAAAAAGA |
| | | TTTTAAAACTAATGGGCAAAAGAAGGTCACCCAAAAAGGAACAAAAATCAAACTGGCATA |
| | | AGAATTCTTAATAGCAACACAGGATAATAACTGAGCAGTGCTTTCATATTGCTAAGGAAA |
| | | AACTTCCAACTCAGAATTCTATTTCTGGCCAAACTACCAATTGATTGTGAAAATGGAATA |
| | | AATATATATTCATATATGCAAAGATTACACAATCTTCTTAAGAAGCTAATTGACAAGTGC |
| | | TCCAGAAGAATGAGGGAGTAAAACATAAAAAAGCAACATGAAAAAGCCAAGAAAAAATGT |
| | | CTACCATAGCAAGAAGTTAATCAACACGAACTACAATTGATAAATCAAATATCAGTGTAA |
| | | GCACTATTTAGATATACGGAGGTAGAAGAGTTAACAGTTGTTGAATTTGGGGTGTATAAA |
| | | TGACAGTTAAAGAATTATACAATTGATTTCATTATAAGCTTTTTGGTGCATGTAATTTTT |
| | | AAGCCATGTGCATGTATTACTTTGATTAAAATACTATTTATTAAAAAACTAAGAAATACA |
| | | TACCCTTAGTACATCTTATAGATACACTCAATAATTTGTGTTTTGGTAATATGTGAAAAG |
| | | ACCTATGTTCAAAGATATTCATTGCCCAAATGTTTGTAAGAGTGAAGGACTGTCAATTAC |
| | | TGAAACCTAAATATTCATCATTAGCAGAGCAGTTAAATAAATCATAGAACTATAGACATG |
| | | AAAAGAAATAAGATATCTCCCTGTATGGTGATATGAAAAGAGCTCTGAACTATATTGTTC |
| | | CATTAAAAAAGCAAGGTGCAGGAGAGTGCAAAGCATGTTCCCATTTTTGTGTATTATAA |
| | | AAGTTGTGTGTAGATATAGATGTGCTGTATAGTCATAGCAAACTTCTGGAAATTTACAAA |
| | | AGTAACTGTTAACTATTGCCTCTAAGAAGTGGGATCAGGAAACTGGGAAGAGAGGAAGAC |
| | | TTAATATTCATTGTATGTGCTTTTATACTATTCATTGTTCACGTGTCACTGTACTCAATT |
| | | TTTCAATGAAAAACTATCTTATATGAATTTATTAATCAGTTCATTAGCAAAAGAGTCTTG |
| | | TCAGACAGTGCAGTGGGCCACTTTACAAATACTCCCTTCCTCTAGGGCTCCTGGTGTGAT |
| | | CCCACAGCCCTTGGAAAAACCAGAGTCGTTGGAAGGAAAAAGAAGCTTGGCTGTGGCGTA |
| | | CATAATTATTTCTCTGTTTGTTTCCAATATCTAGTGCCTGTTCCATACAATATGAATGTA |
| | | AGCACACCAAAATTAATCCTGACTATAATTATACGAATTTTGACAACTTTGGCTGGTCTT |
| | | TTCTTGCCATGTTCCGGCTGATGACCCAAGATTCCTGGGAGAAGCTTTATCAACAGGTTA |
| | | TCTATTTATAGTCTCTCTTTTTCCTCTCTCCCTCCCTCCATCCTTTTCCTTCCCCCTCTA |
| | | TCACTTACCTATTTATTTACCATTTATTTATAACTACCATTCATCCCCCACTTTTATCAT |
| | | CTGTCTCATCTTTAACAGTTGTACTGTTAAATTCTGCCTTACTAATTCTGTTAGAAACTT |
| | | CAAGAAATTGGCCAGGCACGCTGACTCCCGCCTGTAATCCTAGCACTTTGGAAGGCTGA |
| | | GGCTTGAGGTCAGGAGTTTGAGACCAGCCTGGCCAACATGGTGAAACCCCAACTCTACTA |
| | | AAAATACAAAAATTAGCAGGGCATGGTGACAGGTGCCTGTAATCCCACTACTTGGAAGG |
| | | ATGAGGCAGGAGAATCACTTGAACCTAGGAGGCGGAGGTTGCAATGAGCCGAGATCACAC |
| | | CACTGCACTCCAGCCTGGGTGATAGAGTGAAACTCCGTCTCAAAAAAAAAAAAAAAAGA |
| | | AACTTCAAGAAAATTTTAAATGCAATATTTGGAAGAAGACTCCAAAGAACCCCTCCTCTT |
| | | CCTAGAAATGTTAGCCCCCTCCAGATTCCCTACTGCCCTATCTCTCTTGCCACTTTTATT |
| | | TTAAAAATGCAGATACTCTTGAGAGAGTTTATAGATAGTAAAGTCACTGAAACTTCCATGT |

TABLE 17-continued

SEQUENCES

| SEQ ID NO: | Human Allele | Nucleotide/Amino Acid Sequence |
|---|---|---|
| | | GAAGGTGTGGATAGTATCTCCCCACTGAGAGATAGGGCATCAGGAATCCCTGGAGTATTA
GGGAAGCTATATGGTCTGTGGTCAACTGAGCCCACCAGTGCTGGGGGAAGACCAGTTGTC
TGCTACTGTGTGGTTTTTGCTTGAGGTGATGGTCACTTTCCTGTGGAAGAAGGTTTGATA
TTCAAGAACATGCTCTGTCCTTTGCAGACCCTGCGTACTACTGGGCTCTACTCAGTCTTC
TTCTTCATTGTGGTCATTTTCCTGGGCTCCTTCTACCTGATTAACTTAACCCTGGCTGTT
GTTACCATGGCATATGAGGAGCAGAACAAGAATGTAGCTGCAGAGATAGAGGCCAAGGAA
AAGATGTTTCAGGAAGCCCAGCAGCTGTTAAAGGAGGAAAAGGAGGTAGGGACATGGGGT
CAGACAGTGGGATCTGCTCTGGGGAGGGAAGGGGTCCCCAGAGGCAATGTGACCTGAGA
CTCAAGGCTGCCACCCTTGGCCTGGTCTCAGTGCTTTCTCTACTGGTGCTTTTCTGAGAA
TATAAGTCCCTCGAAGAATGGCTGTGCTGCTATCTTTCACAAAATTGTCCAGGCACCAGG
CCCTTCAAAACGGGGAACGCTTGGTCTTGATGCTTTTTGACCTTCTGAAGTCTAAGCCTT
CTAAGACATGCCCTAAATTACTGACTAGACGATACAACATAAGTATATGTAAATCCAGGC
TGTGCTCCAGGCTTTCTTTTGGAAATCTGGAGATGTTTGTGTTCGGCGCCTTTGCTTGAG
GTGGACTCTAGAATAATGTTCACCTCTCCCTGTCTGCAATCCTTGTCTTATTTATAGGCC
ATTCTAATAGTTTCCTTGGAATCTTTACATTCTTCCAGCTCAAGTCTCAGATTTTCAGGA
CAGGGACCATGTTTTATACTCGCACTGATCCTCTATAAGATTTGTCAGAAGGATGCCCAT
CGTAAGTGCTTAACATCTGCACTATCAGGCATAAGTATTTATTGAGTGCCTAGCGCATAC
TGGACACTGTGCTAAGGGGCAGTGACACAGAGATATGAAAGAGTCAATGCTGCTTTTGGT
GGCTGCAATTTCTGTGCAAAAACAGGACATGTTTCCCCAGATAAATAACAGAGCTAGCGT
AGTCCAGGTAGATGATGAGCAATTTAAATGATACAGAGCTACCAGAAGAGAGATTTTCAC
CACTCTCAGGTCGGGGTCATTTGCAATGTTTCATGAGGAGGTGTAATCTGTTCTTTAATT
GCTTTTGTTCAATTTGAAGGCTCTGGTTGCCATGGGAATTGACAGAAGTTCACTTACTTC
CCTTGAAACATCATATTTTACCCCAAAAAAGAGAAAGCTCTTTGGTAATAAGAAAAGGAA
GTCCTTCTTTTTGAGAGAGTCTGGGAAAGACCAGCCTCCTGGGTCAGATTCTGATGAAGA
TTGCCAAAAAAGGTAAGTCTTTTCCAGGGAATTAATGATACCATATTGCTGTCCAGGGG
GACAGGTCCAATTGCCAATCAAATTGAAATAATTCATTTATTCAGTTACTCATTTATTCA
TTCATCCATTTGCACATACTTTCATGCATCCATGTGTCTTTTCAATTATCCATTTATTTG
TAAACATCAATTTAGAGTGTTTACAGTGTTTACTATCTTCTTGGCACTGGGATAGGTGCT
AGGGATACATGTTTTATACTCCACAGAGTGTACGGCTAATGATGAAGATATACTGATAAG
AAGGCAGTTATGAGTCAGTGTGATGACTGATGTGCTGATTGCTGTGGGAGAACAGAGGAG
GAACTATGTGTCAGTGTGGGCTCCCTCTGAAGCAAACCCAAAGACATTACAATGCAAGTA
GATTATTTGGGAAGTGATCCCAGGAAGCACTGGGAAAGGAGGGAAGAAGTGCTATATGGA
ATGGAAGGTAACCAATGAAGATGCATTATCAAGCCAGTTACCACTGAAGCCAGGTAGTTG
GAGTTTAATCCTTCCAAAGTAAGGGCATCAAAGTGTGTGTGTGTGTGTGTGTGTGTGTGT
GTGTATATATAGATATATACACACACACACACACACACACACACACACATATATGTTG
GTATATATATACCAACTTTGGACCATCATAGATTAAAGATTGCTGAAGACAGAAGACAAT
AATTTCCCTCTAATTTCCTACTTGCTGTGCACTAAGGAAGACAGGATTTGAATCATTAGA
GAAAGTCCTCAAGTAAGGACATATGGGTGGGAAAACCAACAGCATCCAGAATTCATGGGG
CCTGGGGGAAAAGCAATGGAAAAGGGTCCCCAGAAGATGCAGTGTGTCAGCTGAAAGGAT
GAATTCACCAGTAAAAGGAAAAAGAGAGCATTACCTGCAGAGAGAATAGAATGTGCAAAA
GCCTAGAAGCGAAGGCAAGCAGGAGAACATGACCCATTAGAAAACTTGCCAGTGTGTGTG
TATGCGCGTGCACGCACGCTCATGCATGCACATGTGTGATGAGGCTGGGGGAGGGTGGGT
GGCACAAGGCTATAGTGATCAGTTGGGGGATCACAAAAGACCTCGAAAACAAAGCTAGAG
AGTTTACCCTTTTCAATGAGGGCTAAGGGTAAAGAGCATTGAAAGGTTTATATAAGAGAG
GGATATGACTGGATTTATGAAATTCTGGATGCATTGAAGACAGGGGATTGGAGGAGGGCA
AAACTGGAGGCGACCAGTTAAGAGGCTGTTGCAGTAACCAAGTAAGAGGTGCCTGTGGCT
TAAACCAGGGTTAGGGAAGTGAGGATGAAGAGCAATTAACAGACGACCGTGATCTGGAGA
AGATAAAATTTAGCAGTTGACTTGATGGACAGTGTGGGGATAAGACCTGGTTTCCGACAT
GATTAGCTAACTTGATGGAGGGTAATTTATGGAGACAGGAAAGGTACACATTTTGGGAGT
GGAAAGATGGCTCATTCAGTTTTGAATGTGCCAATTTCCAGATGCTTATGGGACCTCCAA
GCAGGGATGTTGATTAGGCAGCGTGATGTGCAGAAATGAAGCTGGTGGTGGGGAGGGAT
GGGCAGCAGAAAAAGTTATTCTTATCATTAAGGAGGGGGATGTTCAGACATATTTTAATT
GTCCAGAGAAAAGTCAGAAGAGAGGAAGATGCTAAAGATACAGGTAAAGATGGCAAGAGC
CACTTTCCTGAGATAGAGGGAGATGTAGTAGGTAGAAGGTGGATATGTATGCCTGATAAT
GTGGTGGGGAAAGGGAATTGAGAGGCCTTTGCAGAAGTAGGTAGAAGGATCCCATCCACT
GCTATGATCAGTTCTCTGCTGTAGTAATAGGGAGAGATCTCATAGAAAGACTATCTAGAT
TGGCTTATCACAAAAAAGATAGTTCCCTCTGGGGCTCTGGTGAGTCGGAACCCTTGGAAA
ATAAGCCACTAGGAAAACCCAAATTTTCTGGATAGCTGGAGGTTTGCACTGTTTAATTCC
AGTAACTTTAGAATTGTAGGTAGATGTGAGAGAGTGAGCTAGCCCTTGGGCCCAGCTTGA
GAGTGTGTTTGAGGTTTAGGATCTAGATTTTGTGATATTTAGTGGGACTGTTCTTTTTAG
TTACCAACCGTTTTAAAAACCGTATAGGCGGTTGTTCACTTCACAACTGCAGCTAGCACT
TCACAATCTGGCTCCAGTCCACCTTTCTAAATTTATACTCCACTTCTTACCTTTAAACAT
TGTTTACAAATTGGATTTTGTATTGCTTTCATACCCGGAACCATTGCTTACTAGTTTTTG
TAAAATTTTGTTTGCTCTTTGTTGGCAGTGAATGAAACACAGAGAAAGTAAAATGTCTGT
AGGTAGGACTCTAGAAATGTGCATGCATAGGAAATATGAATGATCAAACCAGATTTCTCT
TATTTGTTAAACATGAAATAAGAAAACTGAATATTTGGCATGCTGTAAAGACGAGGTGAG
TAGACCTATAGAAAATGTTGAGCACTTTCATTACATGTAGCATTGGAACAAAGTAGTTTG
TTAAGTTTTGAGGAGAGGCAGCCCCTGTCTTTAGAAGGTGCCCTATGCCTTCTCTTACAG
CCACAGCTCCTAGAGCAAACCAAACGACTGTCCCAGAATCTATCACTGGACCACTTTAGT
GAGCATGGAGATCCTCTCCAAAGGCAGAGAGCACTGAGTGCTGTCAGCATCCTCACCATC
ACCATGAAGGGTAAGTTCCACATCCCAATCCAAGGGAAAGTCTACTTCAGTGATGTCCTT
CCATTCTTCTTCTTCCCAATCCCCTAGAAGCCCTCTGCAAAGGAGGCTGTTTTGGAACCA
ACCCACTGTACCATCCTGCAAAGAGTGACTTCCTTTGCCTCTTTGGAGCATGTAAACAAA
GTGGCTCACAAGAAGCAGACCTTCCCTGTGGGCCCACTCTAAACTGGCACCTGGGTAGAG |

TABLE 17-continued

SEQUENCES

| SEQ ID NO: Human Allele | Nucleotide/Amino Acid Sequence |
|---|---|
| | GTGGAAGCTGGCTAGACTTGGGATGGGACTTCAGACAAAATGCATAAACAGGGCCTCAAA<br>CCAGGCCTGGGAGTCACAAGAGATCCAAGTGACAACAATAGTCAGTCAAAGAACAGAAGA<br>CTTTGAAGTCTCCAGGAGGTGGCAGTTGTTATTGAAGTTAGAGTCAGAAACCCCACATGG<br>GCAATAGAAGACCTATGTAGAAAGGCTGGAGCCATCTGATGGACCAGATTAATAGCAGGT<br>AACAGGACCCCACCCCAGGGGTTGGTGTTCAGGAGCAGGATTTACTCCCTGCAAGGGGGG<br>TCAAATAGGTCCTCTAGCACTTTTAAGCCTACTGCATCATCTCGTTTGCCCTGCATGTGT<br>CCCTGCAGCGGTGCCAGGGAAATCAGGGATGGTCTGAACTCAACTAGAGGATAGAGTCCC<br>TTTTACTGTTTCAGTGCTTATAGATGCCCCTTCCCTTGAGCCCTGGTTGCCCCTTTTGCC<br>TCTGTTACAGCTGACCTTATGGTCTGTCTTGAGTGGACATAACTTGTGCCTGTATCTATC<br>TCTCTCTTGGATTCACAGCCAGCCAATGTTGATTTCCACATCTATATATCTAACATCAAA<br>GCTCAGCTCCTGGATGCTCAGTAAGAGTGTAAATATTTGATGGACTTGACTGTACCGCAT<br>GCTAGTTGTATGTGGAACATTGTCTCTTCTGCACTAAGATTGGTGGAAAAACCTTTCTGA<br>CTACACAAATCAAAACATTTCACAACTGATCATGTATCAGGAGGCCCTGGGGAAGAGGGA<br>GGAAGGAATGCACTCAGGCAAAGGCATCTGGATTGCTTCAGAGCTAACTCCTCAACCTC<br>TCGCTCATTCTCCTCCAGAACAAGAAAAATCACAAGAGCCTTGTCTCCCTTGTGGAGAAA<br>ACCTGGCATCCAAGTACCTCGTGTGGAACTGTTGCCCCCAGTGGCTGTGCGTTAAGAAGG<br>TCCTGAGAACTGTGATGACTGACCCGTTTACTGAGCTGGCCATCACCATCTGCATCATCA<br>TCAACACTGTCTTCTTGGCCATGGAGCATCACAAGATGGAGGCCAGTTTTGAGAAGATGT<br>TGAATATAGGGAATTTGGTAACATTACACTTTTTAAAAATAAAAAACATATTTCATACTT<br>TAAAGTATAACTTTTTCAAAGTCTAAACATTTTGTGAATGAGCTAACCTAACCTAGGTTT<br>TTGGTCCCCTTCAGTGGAGTGAGGGAAAAGATGGCTGTTACGGTTTTACTTTTACCCGGT<br>TCATTTCAGAAACTGTCCATGTGTCCTGAGTTGGCCCTCTGGTATGTTCAGGTATCTCTT<br>TAGCCATTCAGTGGTAAGCCAGATACAAGCAGACATCCTAAAAGTTCAGCTCTCTGAGAT<br>AATCAAGAAAATGTTAACCATATCCAGAGAACCGTGGTAATGGCTGTTGTGGTCCCAGTG<br>ATATTCATGACATCATTTGTCACAAAATAATGTGACTACTATTACTAGGTGTTATTCTCC<br>CTGGAAAGATGAATCAGGGCCTGTCAGCTGTGGAAGTTTCACTTTTTTGGAAGGGGTTGT<br>TTGGGGGTTGGTCAGGCTGGGGTGGGGTGAATTTCCAGACTTGAGCCTGCTTCAATATGT<br>TTCTCATTGGATAGATCTAGTCTCAGTTAAATTGGGAAAACTAAGGGGAGCAGACTTTTC<br>AAGGACTGTTCACTTCAGTTTATGGTTCTTGTGGAAGGCATTTTTCTCAAGGAAAAATTA<br>GTCCCTCGAATATCAGAAACAACAAATAATTGCCCACGGGATGATCTACCCTAATTAGCT<br>GATGGATTAATGAGCTAAAAACCTTACCAGAATGTCTAGCCTTTTCTTCTTAAACTTTTG<br>TTTTATCTTTCTAATTTAAAAAATAATAAATGCTGTTTTATTTTTTAAAAATAAGGAAAA<br>ATATAAATAAGGGAAATAGAAGAAATTCATGTCCCATGTACCTGCTGACAAAGATGATCA<br>TTTTTAGCATTGCAGAATATTTGCAAGCTTTATGTAAGCATGTATGTATGTGTGTATGTA<br>TTTTTATTTAGTGTTATTTTTTCTCCTTTTTTGGCATTTTTTTTTTTGTGATGTCTTTTT<br>ACATGTCTTTAAAAAATTTGTTTTACATTGTTAAGAACCCACTGCAGCCGAGCACAGTGG<br>CTCACGCCTGTAATCCCAACACTTTGGGAGGCCGAGGCAGGCAGATCATGAGGTCAGGAG<br>ATCAAGACCATCCTGGCTAACACGGTGAAACCCCATCTCTACTAAAAATACAAAAATTTA<br>GCCGGGCATGGTGGCAGGCGCCTGTAGTCCCAACTACTCAGGAGGCTGAGGCTGGAGAAT<br>GGTGTGAACCAGGGAGGCGGATCTTGCAGTGAGCCGAGATCTGCCACTGCACTCCAGCC<br>TGGGTGACAAAGTGAGACTCCATCTCAAAAAAAAAAAAAGAACCCACTGCACTAGAGTCA<br>GGTACCTGTCATCCTTAGTTCCACATCCCTCCACAAGGAGCAGTGATACAGTGGAACTGT<br>AGTATAAAACCAGGGTGGTTCTCCTCACAGGCAGTCTGCACATAGCACATAAATTCCTTT<br>CTCCATGCTGCCTTTGGGAATAAATGCTTTGTGGGTGTGAATGGGTTAGACTAGATTCCA<br>TGCTGCTTGACAAACCTAACACATAGTTGCTTGTAACAGATCAGGGTCTCCTGGCCATGT<br>ATTCAGCTATCCTCTGCTGAGGCATCTCAGAAATGAGCTGAAATTGTTTCAGTTGAAGGC<br>AGCAAGCTGTGTCTATAGGGGCATGGTCAGCAGACTCCACCTTTTAGCACCTCCTGGTGG<br>AATGGAGTTACTGAATAAGTTGTAGAGAATACTCAAAAACCCAGAGTCATCTCTGTGGAC<br>AGGGCTTCCCAATTGCAGTGGTGATCTGTTTTCATCTGCTGGTCCAAATTTAGAAAATGA<br>GAAAAACCCCCATCTCAGATTTACCACTGACTAGACATCCTGAGTGTGGAGGTGAAGCTA<br>CATTTTGCAGTTGGAAACTGAGTGATTGACATTCTTCTTCACTTCCTCCAGAGCAGGAGG<br>AGCCACAGGGCCACAGGGACATTGTTGTTTTCCAAGTACACAGGCAGCAGCTGCACCCTA<br>GCTCCTAAAAATTGGCAGGAAATATGTAGAACCATACACATAGCTTGTGTTTCCATTCCA<br>TGGGCCTACTCCCTGGACATACAATACCAAATGGCAGCCACACTATTTACTGCTCCCAT<br>GGTAGTAGTGGTGGAGAGAAGCCTTGGAGTCTTAAGTTCCAAGGAGCACATCAAAACTTC<br>CCTCCTCTGATGCATGGGCCAGGATTAAGCCACTCTGTAGAGTTCTGCAGGACTGGACTA<br>GAAAATTAACTCTCTAGGGTAGAGATTGCTCTAATCAGAGGGATACACTGAATGCCAAGA<br>AGCCATAAAGAAAAGTTGGATTGAATTGACAAAACAATGGTCCCAAGGTATCTGGTGATG<br>CTGTAGAGCTTGATGCCTAAAGCCTAAAGGAGATACAAGAAGGAGGAGTGAGTCAAAAGA<br>GGTGGGGATGACTACACAATTATCTAGGACAGGCATCACTGTATGCTTTTAGATACTGGT<br>GGTGACACTGAGCAGGAGTAGATGGCAGTATTTAAAGGGGGAATATGAAAATAAACTTGA<br>ATTTTCTTTGTAACTCTTGATTTATTTTTATTTTTCTACCCTGGATTTATCTTTGCTATC<br>CTTTTGTCTTTAACTTTTGCCATTTTATTTCAGGCATTTTTAAAAATAAAATAGTAAATCA<br>TTGAATCATTTATAAAAATAGATAATCCATTATTTTTAATAATCGAATTTAGTCGTTTAT<br>AGGTTCCCCCCAGAATTGTAGTAGACAGTTTTATAACAATCCTTGTAAAGACTTTAATCC<br>TTTTAATATTACCTTATTATTTTTGTATTCTTGCTTTTTTCATTTCTATTTATTTGTGTT<br>TGTATGTGATAAGACTGTGCTGTTTGCCGTGAAGAAATTATTTGCTTTATTTTTTGCAAA<br>GATATGGAAGACAGATTTATTTTTTAATTGGCTACTACATTCAACATTTTTACATATTTC<br>TTAAGCTTGTATTTATCTGATTATTGAAGACAAAGACAAAACTATTTTGCCCATGGAAA<br>TACAAAATTCAGTACTTTTTGTAATTCCTGCCTCTCCTTTTTATTCTTTGATATTTTGTT<br>CTGGAAATGTGAGCCCTGCATTCTGAATGAGTTTTAGGATTATATTCTGATTCACTAATT<br>CTCCTTTCAACCATAACAAATTTAAGGCTTATCCCATATATTGAGTTGCTCAAAGACTTT<br>TTTTTTTTTTTTTGCCCCTGGAAGTGTTTTCTAATTCTATGATCTGTGCCCCTTTTTG<br>TTTTTATTTTTAATTTTTCTGATCAAGGTGTTGAAATTAGGTGGTCAGGTGAACTCCTCC |

TABLE 17-continued

SEQUENCES

| SEQ ID NO: | Human Allele | Nucleotide/Amino Acid Sequence |
|---|---|---|
| | | TGGATTCTAGTTTATGGGGATAATTATCCTTAGTTTTCAGGGCTATTGTTTACATTCCT<br>TCTCTCCCTATTTTAATTGTTTTAATTGGTATTCTAAAGAGAATTCAGAGGAGAAATTGC<br>CTGACACTCTGTCACCCTGCCATCTACCAGTAATACCATTTTGCTTTATCTTCAACAGAA<br>TGAGAAATAATATTCATTTTCCATTCTGGTGTCTGTGAGCTTGGTTACATTGCTCTGGGC<br>ACCATGGAGAGGGATGGAGAGAGGAGCAAAGTCATAGTGAGGTTCATGCTACAATAGTAA<br>ATATTTCTATTGCATGGACTTTAGGGTATAGTGTGTCAATCATGAGAATACTTTTCATTT<br>CATTGTAACCTCTGTACTTCCCTTGGGCCATTCTTAAAAGTGTTATCTCCGCAGCTTCCT<br>TCTCTCATTCTTCTTTGTCCCACTCTAGGTTTTCACTAGCATTTTTATAGCAGAAATGTG<br>CCTAAAAATCATTGCGCTCGATCCCTACCACTACTTTCGCCGAGGCTGGAACATTTTTGA<br>CAGCATTGTTGCTCTTCTGAGTTTTGCAGATGTAATGAACTGTGTACTTCAAAAGAGAAG<br>CTGGCCATTCTTGCGTTCCTTCAGAGTGGTAAGGCACTTTCTTATTTTACTGCATAAACG<br>TAGCTGCCTAAGTGGAAAAAACGTTTTGAGTGAGTTCAGTGGTTATCTTGTACTAAACTT<br>TAATTTATCTTACCTTAACCCCAGAACCAAAACTGCACTCCTCTTCCTGCACAGGTCTTT<br>AATAGTCTTGCAAGTCCCTGGGGGACTTCGCTTAACTGAACCCTTATACCCTTAGCCCA<br>TTCCTGCCAGAGATGACCCTTTAGGCAACTGGGTACAAAATTGTGTCTCCCAGTGTGAGG<br>ACTCTGTTCCTTGCTCTGTGCACAACCCTTCCGACACTCTTTTTTTCCCATGGAGCTGTG<br>AGGCAATAAATAAATAAGGGAAAATATTCCTATCTTTCAGGTCATATTGGGCTCGCCAAG<br>GGGGGCAAAGACTATAGAATGCCGGGGAGGAATGCAGGGGAGCTGATGGCAGGTGCTATC<br>TATCTCACAAGTTTCCTTCTCACTGCTGCCAGTGCTACATTTCTGTTCTGTAGTCTTTGC<br>CTGCTATCCAGTTTGGAAGCATTCTGGAAACCTTTACAAAGTACCTAATATAAACTGACA<br>TGAGGGAAGGCACAAAGGATGAGGAAATCATTGTCTTTGAGAAGGTTGCAGCACAGGAGT<br>GATACAAGACTGGGCTACATGCACAGTACAGTGTGACAGAGCCCAGGAAAGGTATAGACA<br>GAGGACTACAGAGAAATCCAATCTGAGAAGGGGAACTAGAAAACCTCCAAGGTGGGATTT<br>TGTCCCCTTTCAAAGATATTTACCTTTTTTTTTCAGATAGGATTTTTAAGCCTATAGAGT<br>AAGACACCTCATTCAGTTACCTAAATGTACATTTTATATTTTTATACTTGGGATATAGT<br>AAGAGGTTACACTGCTCAAAGTCAGGTGTTATTAAGCTTTCCTACTAATGTTTTATTAGC<br>ACTCAGGTAAGCAAAATTGCATTTGCTTTATCATTGTTTAGGCTTATTACAGCCAGGCTC<br>TAATGCACGGAAATCTGTGGCATTGTCTCTGTATGAGAATGGAACCACAGGTTTTTCCTG<br>GGATGCTCCTAGCTCCCCTTTGAGTAGACAATGACAGTCCTCTTCAAGCAGAAGCCTTAC<br>TGACCTGCAACATTTCCATCCCCAAATAGGGGATGTGCTTAACAAAATTGTACTTTGGAG<br>TAAAACCGTCAGTTTATATCAAAAGTTAATATAAGAAACAACCTATAAAACAAGTTGCTA<br>TGTTTTCTCTAAGGTTGTTTCCTATAAAGTCCGTGAAGATCTAGGATAAAATTTCTCTGT<br>GGGAAAAAGTATACAAGTCTTGAATAGCTGGTTGCCTTTTCTCTCCTGACTACAAATGCCA<br>TATTACTCTAATCATTCTTATGAGGCTTAGATTCAGACTCGTGGCCTGAATTATATAATG<br>CAGAAGTTAGCAAACTTTTTCTGTAAAGGGCCACATGGTAAATGTTTTCAGCCTTACAGG<br>CTGTGTGGTCTGTGTGGCAACCGTTAAACTTTGCCATTGTAGCACAAAAGAAGCCATAGA<br>CTTTCAAAAACCAGTGAGCATGGCTATGTTCCAATAAACTTTATTTATGGATGCTGAAAC<br>TTGAACTTCATATGATTTTAATGCATCATGAAATATCCTTTTGATTATTGTTATTTTCTT<br>TTTTGAGACAGAGTTTGGCTCTGTTGCCCAGGCTGGAGTACAGTGGCGTGATCTCAGCTC<br>ACTGCAACCTCTGCCTCCCAGGCTCAAGCCATCCTCCCTCGTCAGCCTCCCGAGTAGCTG<br>GGACTACAGACGCACACCACCACGCCTGGCTAATTTTTGTATTTTTTGTAGAGATGGGGG<br>TTTCACCATGTTGCCCAGGCTGGTCTTGAACTCTCCTGTGCTCAAGCGATCACCCACCTC<br>AGTCTCCCAAAGTGCTGGGATTACAGATGAGAGCCACTGTGCCTGGCCTGATTATTTTTC<br>AATCATTTAAATGTGGAAAAGTATTCTTGTCTCTGAGGTCATACAAAAATAGGCAATGGA<br>CTGTATTTGGCTCTCAGGCCAGAGTTCGCTGACGCTTGGTATATTACATATAATTCCAAA<br>ATATTCATTTTATATAATAATTATGTAGCTCAGTCACCATGCTGATCCCAAAGTCCTTAA<br>TGATTAAAAAACTAAAACAAAATATTTCCTTTTTTTTTTTTTTATGAGATGGAGTCTT<br>GCTCTGTCTCCAGGCTGGAGTGCAATGGCGCAATCTCAGCTCACTGCAACCTCTGACTCA<br>CAGGTTCAAGCGATTCCCCTGCCTCAGCCTCCCGAGTAGCTGGGACTACAGGCATGCGCC<br>ACCATGCCCAGCTAATTTTTTTGTATTTTAGTAGAGACGGGGTTTCACCATGTTGGCCAG<br>GATGGTCTCAATCTCCTGACCTTGTGATCCACCCGCCTTGGCCTCCCAAAGTGCTGGGAT<br>TACAGGCGTGAGCCACTGTGCCCGGCCAATGTTTCCATTTTCAAATAAGAAAGTAGATAC<br>AGGTGAGCATTAGATTATGACAGCGATCTGATGGCTATGTTCAGGATAGATTTAACTTTG<br>AAGAGAGTTTTGGATGTCATAAGTTTGGGTATATGTCATTTGCTTTATAGATGAGCAGAT<br>GGAGTTTGTCCTTAACTGGCTTTTCTTCCATTTTTGTTTGTTGTCTTTTTCTACAGCTCA<br>GGGTCTTCAAGTTAGCCAAATCCTGGCCAACTTTGAACACACTAATTAAGATAATCGGCA<br>ACTCTGTCGGAGCCCTTGGAAGCCTGACTGTGGTCCTGGTCATTGTGATCTTTATTTTCT<br>CAGTAGTTGGCATGCAGCTTTTTGGCCGTAGCTTCAATTCCCAAAAGAGTCCAAAACTCT<br>GTAACCCGACAGGCCCGACAGTCTCATGTTTACGGCACTGGCACATGGGGATTCTGGC<br>ACTCCTTCCTAGTGGTATTCCGCATCCTCTGCGGGAATGGATCGAAAATATGTGGGAAT<br>GTATGCAAGAAGCGAATGCATCATCATCATTGTGTGTTATTGTCTTCATATTGATCACGG<br>TGATAGGAAACTTGTGGTATGTGTCTTAGATTTTTTCAAAAAAAAAAAAAAGATCCTA<br>CATGCCTCTCAAATGCATTACTTCATTTGCAAAACTTTACTAGTAAAATTATTATTCTA<br>AATATAATGCCAAATAAATATTTGAAATATTCATTCAAATTTTGTTTGAGAAAGTATGA<br>TAAGCATGAAAAAACCTCTTTGACACATATTACTCATTTGACTGATGCCCCCAAATTTAT<br>TTTATTCCAGATGATTATTCTAAGACAATAGTATTCTCTTCCCCAGTGATTGGCTGAAAT<br>AGGAGTTAGTGAGTTAATTTGGTCAATAGGATGTAAAGAGATGTCCACTGGAGCAATTTG<br>GGAACAATCTTTTGTTCTTAAGAAATATGTGTTTTAAAAAATGATCGTTTTACTTCCTC<br>TGGGCTTTTTTATGACTGTGACCCCTGGAAAAGCCAGATCATGAGCTTAGAGCTGTGGTG<br>GAATTGCCCACAGGAATATGGATCTGACATCCAGGACTGCTGTGCAATCCTCTCCTGTTT<br>GCACGAATTGAGAGATGGTGTACTTTGTGCAGTGTCTTTAGGTCCCTGTTCCCCTAACTT<br>CAATGAGGTATTGGGGCCTAGCCAGAGGGGTTTGGACCAAACCTGCAAACATTATGCAAC<br>CATGAGAAGAGCCAGCCTAAAACAAAGCCAACACTGAGGCAGGTAGAGTGAAAAGAGAGA<br>ACAAACCTGTATTCATGTCATAATTGGCCTGCTGTTCTATTTTCGAACTTCTTGTTATGC |

TABLE 17-continued

SEQUENCES

| SEQ ID NO: | Human Allele | Nucleotide/Amino Acid Sequence |
|---|---|---|
| | | TACAGATTTTTGTTGTATAAGCTGGCTTGAGTCTGTTACTTGCAGCTGGAAGCATAGATA
TTTATGAGGAGGCTAATTAAGTGCACTTCATTGCCTTACTGCACAAGATCTTCAGGATCA
AGTTGGGGTTATAGTGCAATATAATTAACTCTCTACACACGATAGCTTTATCCTAAGTAC
CTAATAAATGGTGTGCCTAGACACTAAGTGATACATACAAAAGCTCAGAAGAACAGGGCA
TCACCAGTGGGAGTGGGAGGAGAGCACCGAGAAAGGATTCGTGGAAGATTACAGAACTTG
AGAAGACCACTTATATGGTAAGGAGGACTTAGACAGATAGAGGGAGAGCTTAAGCAAAGAT
CCAGAGGTGGGAATTCTCACAGTGCAGCTGAGGAACTGTGACTAGACCCATTTACACCCA
CCAGGCACTTCTCTCCAAAGGCTGTCTATTGTCGAGCTGAAGAGAGCCACAAACAAAGGA
ATTTGAGGAGGTAAAGATGATGAATTAGAGAGTGTGTAATTATGAGCAAAGAACCCAGGT
AGGAAGCTATTGGGATTATGTGAATTTGAAGTGATATGTGGTTCAACGAAAGAGTTGCAT
ATTTGGTCCAACTCGCTTGGCTTGGCCCCAGTACGTTACTAAGGTTAGGGCAACAGGACC
TAAAGAAACTGTAAAGTACATCATCTCACAAATATTCAAATAAGAAAGGACTGTACATTG
GGCTTGAATATCAGATTCATATCCTTGTGGGAAATTCCAGCAAAAATCAAAGCTCACTAT
CCAGCTGTTCCTCAAGAAATGTACTCTCAATTTTGCCATATGGTTATCCCATTCTGCTTT
ACCCTGGTAAGGGTCTACTCATCCATATTATTTATATGTAGGGAAAGTGGACTTGGCTAT
TTGCACCCTTTAATTTCAATTTTTATTCTGTCTTACTGTTTCTATTTCTTTCTCAATCTT
TTATTTATTGGATAGATGAGCTTTCTTAGGAGACAGTGGGACATAAAACTCTAATTTGAT
TCTGTTTTTAGTCTTGGGGAAAAGTTGTCCTGGAAACCCACTATATCTTTTCCTTTGCTA
AACTTTCCTTTCTTCTTGCTACCCCACCCCATTCCCAGGTGCTCAACCTCTTCATTGCCTT
ACTGCTCAATTCCTTTAGCAATGAGGAAAGAAATGGAAACTTAGAAGGAGAGGCCAGGAA
AACTAAAGTCCAGTTAGCACTGGATCGATTCCGCCGGGCTTTTTGTTTTGTGAGACACAC
TCTTGAGCATTTCTGTCACAAGTGGTGCAGGAAGCAAAACTTACCACAGCAAAAAGAGGT
GGCAGGAGGCTGTGCTGCACAAAGCAAAGACATCATTCCCCTGGTCATGGAGATGAAAAG
GGGCTCAGAGACCCAGGAGGAGCTTGGTATACTAACCTCTGTACCAAAGACCCTGGGCGT
CAGGCATGATTGGACTTGGTTGGCACCACTTGCGGAGGAGGAAGATGACGTTGAATTTTC
TGGTGAAGATAATGCACAGCGCATCACACAACCTGAGCCTGAACAACAGGTATGAAGGTT
CACACATAGACTTAAAGGTCATACAAAGCTGGAGTTATCACAGGGCACTGGTAGCCTGCC
CTTTTCTAGGCACTATGCAAGGATAATAAGGGTACAAAACGTGGCTGCCCTTTGATACCC
ATGTGCACATCTCAGGACAGGTTCTTTATTGTGGTCCTGCAGGTGTGGCACAGATAGGAG
GTGTCAGAAGAGTTCAGAGGGGAGCAAAATCAGAGTGGGCTGGGATGACAGGGGGAGTTC
CTTTGGTTGAACTCTACAAGAAATGTAGAATTTGGACTGGCTGAAAAGTGAGGAAAAGGG
GATTGGGAAGTAAACTGAATAGCATGTTTTGTTTGTTGGTTGGTTTGTTTGTTTTAGAAA
AAAAAGGCAGTGCTGGGAACAAACTCAGTTTCTGCAGAGACCAATCTTGTGGGTGAGGAG
TGGTGGGAGATGAGGGCTGTCAGGGAGTGTGAGGGTAATGGATATTGTATTAGTCTATTC
AGGCTGCTATAACAAAATATTATAGACTGGGTAACTTCTAAACAAGAGAAATTTATTTCT
CGCAGCTCTGAAGGCTGGGAAGTTTCAGATCAAGGCAGTGACAGATTTGATGTCTGAGGA
GGGCCTGTTTACTGACTCATATTTGATAGCTATAAATTTCTCTCTAACCAATGTTTAGCT
ATATCAAATACATTTTATTTTCATTTTTATTTTCTATATATTTAATTATATTTTATTTTA
TCTTATTTTCTAATTCTTCTTATGATTTCTTCTTTGACCCACTGCTTATTTAAAAATGTG
TTGTTTAATATTTATAAATATCTCAAATTTCTATTTGTTATTAATTTCGAATTTCACTCC
ATTGTGATCAGAGAACATACTTTGTACAATTTCAGCCCTTTTAAATTTTTGAGGCTTGTT
TTGTGGCATAGTGTATTGTCTATCCTGGAAATGTTCCATGTGTACCTGACAAGAATGTGT
ATTCTGCCATTTGGAATTAAGTGTTCTATAGATGTCTGCTAGGTTTAACTGGCTTATAGT
TTTGTTCAAATCTTCCATTTCCCTGTTGATCTTCTATCTAGTTGTTATTCATTCATTTCT
GAAAATAAGGTATTGAGATCTCCAATGTTTATTGTGAATTGTCTGTTTCTTCCAACAGTT
ATGTCAATTTTCATTTCATATATTTTGGGTCTCTTCGTTAGGTGTGTATATATGTTTAT
AAATGCTATATCTTCCCAATATTTTGGTTCTTTTATCATTATAAAATGTCCCTCTTTATC
TCTAGTAAGTTTTTTGTTTTTAAATCTATTTTGTCTGATGTTAATAGAGTCATCCCAGCT
TCTTTTATGGTTGCTGTTTGCATAACATGTCTTTTTCCATCCTTTTATTTTCAATCTATT
TATATCTTTGAACCCAAAATGTGTCCTCTGCAGACAGTGTATAATTGGATCTTGTTTTCT
TATCTATTCGGCAATCTCTGCCTTCTGATTGGATTGGTTAAACCATTCATATTTAATGC
TGTTGTTAATTCAGTTTATTTACTTCTCATATTTTCCTGTTTGTCTTCTATATGTCTTCC
ATGTTTTTCCTTTATTATTTCTCTACTGCTTCACTTGCATTAAGTAAATATTTTCTAGT
ATAACATTTTAATAACTTTAGTTTTTTCAAATCTTTTTGAATTATTTCCTTATTTGGGT
ACTCTAAAATTTGACATATACATCTAACTCATCAGAGTCTATCTCAGATTTATATTAATT
CCAGTGAGCTATAGAAATATTACTCATATATAGCTCTATTTCCTCTCTCCTGTTTTTGTA
TTGTTTTAAATTCTACATATTATATTCATATATGTTAAAACCCAAACAACTTTTTTTTAT
TATTGCTTAATATAACTAGATGTCTACTGAAGGAGCTGAGAAATAAAAGAAAATAAGTG
TATATTTATAAGATTTATTTTAATAAACTTCTTAGTTACTCTTGGCTGTCTTCATTTGTT
CCTGTGACTGTGAGTTACCTGCAGGTGTGATTTTCTTACTCCAATGCAACTTTGCTCCCA
CCCATATCCTTTGTGCTCTTATTAGCAAATATATTTTATTTCTATATGTTACATACCCAG
CAACACAATTTTAAACATATTGTTTTACACAATTGCTTTTGAAATCAGCTAAAAGAAGAA
AGGAAAAGAAATATATATTTTTTATCATACTTGTGTGTTGTATTACCATTAGGGTCACT
TGTTTTTTGCCTGTAGGATGTCCTTTAGTATTCTTTATAAGGTAGGCGAACTACCAAAGA
ATTCTCTGTGTTTTTCTGGGAATGTGATTATTTCATCTTCATTTTTGAAAGATAGCCTCA
CTAGATATAAAAATCTTGGTTCACTGTTGTTTTTTCTTTCAGCACTTTGAATATATCATA
TCACTGCCTTTTGGTCTCCATTATTTCTAATGCAAGGTCAGTGTTAATTTTATCAATGTC
ACCTTGTACATGATGAACCACTTTTCTCTTGCTACTTTCAAGATTTTCTCTTTTCTTTGT
CTTTCAGCACTTTTACTATGATATGTCTAGGTGTGGATCTCTTTGTGTTTTTTCTACTTG
GGGTTTCATTGGGCTTCTTAGATGTGGAGTGCTAGGATTTGAATGTGTCCTCTAAAGTTT
ATATGTTGGAGAATTAATTCCCAAAGTAACAATGTTGAGAGGTAAGACCTTTAATAGGTG
ATTAGATTATGAGGACTCTGGTCTCATGAATGGATTAATGCTGTTATTGTGGGAGTAGTT
TAGTTACTGTGGAAGTGGGTTCCTAATAAAAGAATGAGTTTGCTGCCTTCCCTCCTTTCT
CTTTCTTGCCATGTGGTGATGCCTTCTGCCATGTTATGATGCAGCAGGAAGTCCTTCACA |

TABLE 17-continued

SEQUENCES

| SEQ ID NO: | Human Allele | Nucleotide/Amino Acid Sequence |
|---|---|---|
| | | AGATACTGGCCTGTTGATCTTGGTCTTCCCAGCCTCCAGAACTGTAGGAAATACATATCT
GTTCTTTATAAATTACTAATTTCAGGAATTCTATTATAGCAGCATAAATTGGACTAAGAC
GTGTAGATTAATGTTTTCGATCAATTTTGAGGAGTCTTCAGCCATTACTTATTTAAGTAT
TTTTTCTGTTCCTTTCTCTCTTTCCTTTCTGGTTGGTGTGCTTAATGGTGCACCACATTT
CTCTGAGGCTCTTTTTATTTTTCTTTCTTTTGTTTTCTCTGTGCTCTTTAGATTGCACAG
TCTCTGTTGATTCATCTTTAAATTCACTGGTTCTTTCTTCAAATGTACTGTTGGTCTCTC
TAGTGACTTTTTCATTTCAGTTATGATAATTTTCAACTCCAAAGTTTCTATTTGGTTCTT
TTCAAAATATAATTTCTATTGATATTTTGTATTTGATTGTATATGGTCATAGTATCTTTT
ATTTCCTTAAGCATTGTACCTTTTAATTCTTTAAATATATTTATAATGGCTTCTTTGCAT
TCTTTTTCTATTAGCTCTGACATCTTGACCCTTTCATGTGCAGTTTCTGTTACTGACTGT
TTTCCCCTGTGTGCGTCACACTTTCTTGTTTTTTGCACATTTCATATTTTTGTTTTGTTT
TGAATTGGACATTTTAAGTAACATATTGTGGAAACTCTATAACTGATTCACTTTTCTCCT
CTCTGAAGCTTCTTTATTAAATGGTAATCTGGCTAGACTATTTTAGTGGAATCTGCTCCC
TCTCCAACCTATCCCCCTCCATTCACACACAATGTGAAAGCTTTGGTGTCACTCCTAGGA
GAGTACATCCTTGGATGTGCACACGGTCAGTGTAGGATGACTGTTGTTTCAGCAAGGCTA
TCTTTGTCTCCTTTTGTGATCTCTCTGTTAAGCTGTCTGCCTCTTTTGGTATTACACTTC
GATTTTAGGCTCAACTAATTGCTGGATAATTGCTCTATTTTCCTTGACAATGCCATGGGG
CATAAATTGCTCAACTGTCTGATTCAATTAAATTCAGGAAGTGATAGCTTTTAAGCGCAG
TCTTTGAGATTTGTTTTGACCCCAGGGGGACTCTCCTTAGCCATCACTTTCCGTAGTTCT
TTGTGGTGAATTTGCTGACCTATGTTTTAGTTTCTTGCCTTTAATGAAGGAGAGCTACCA
ATCTCTTCTTATTTGCTTATGATCAAAATATCCAATATCCATTGTTTTCAAGAACACTCT
TAGACTTATACTTCCCCACACCACTTTGTTTCAAATAAAGTCAGTTCTATGGAGAGCTTC
AGAGCTCTTTTTTCTTATGAATTACCTCCCACTCTGGGCAAACTCTTTTAAGCACAATTC
CAGGCACTTGGGCAGGGGCAGTAGCCTCTCAACTTCTCAGTTTCCTTCTTCCTTAATCCT
CCCCACCCCCAGAGCTTTTGCCCTACAAGTAAGCTGGAATGAGGATGATTCTAGTATTCT
TGGGCTGCCGCTTCTGGGATAAAGTCTCTGCCCTATGAGTGGAGGGCTAGATGGAAAAAG
GGAGCCAACTTTTTGGCCACACTCACCAGAAATTTAGAGGCCTTAACTCAGAGTTGGAAG
AGATAAGAAATGCTGATGGCCTGCAGCTGCTGCTGCTTTTTTTTTTTTTCCATAACTCATG
CATTTTTATTGGTAGGCATTTCATGGTGGTGTAATCATTTATGCATTGGAAAATGGGATT
GTTTTTGATGATACTAAACAGCATTTATTTCTTTATTTTATTTTATTTTATTTTATTTTA
TTTTATTTTATTTTATTTTATTTTATTTTATTTTATTTTTTTGAGATGGAGTCTCGCTCT
GTCGCCCAGGCTGGAGTGCAGTGGCATGATCTCCGCTCACTGCAAGCTCTGGCTCCCGGG
TTCCTGCCATTCTCCTGCCTCAGCCTCCCGAGTAGCTGGGATGACAGGCGCCGGCCACCA
CACTCGGCTGATTTTTTTGTATTTTTAGTAGAGATGGGGTTTCACCATGTTAGCCAGGAT
GGTCTCGATCTCCTGACCTCGTGATCTGCTCTCCTCGGCCTCCCAAAGTGCTGGGATTAC
AGGCGTGAGCCACCGCGCCCGGCCAGCATTTCTTTATTTCAAATGCATTGAATGACCACC
ATGTGACAGGCCTTGCACTAAAATAAAATAAGTATGCAATAAGTAATTTTTTTTTTGAGG
CGGAGTTTTGCTCTTGCCACCCAGGCTGGAGTGCAACGGCACAATCTCATCTCACTGCAA
CCTCTGCTTGCCGAGTTCAAGCGATTCTCCTGCCTCAGCCTCCCAAGTAGCTGGGATTAC
AGGTGTGTGCCACCATGCCTGGCTAATTTGGTATTTTTAGTAGAGATGGGGTTTCACCAT
ATTGGCCAGCCTGGTCTTGAACTCTGGACCTCAGGTGATCCGCCCACCTCAGCCTCCCAA
AGTGCAGGAATTACAGGCATAAGCCACCGTGCCTGGCCTGCAATAGGTAATTTAACATGT
AGGCTGTATTTTTTTAATGTAAGCATTTAAAAAGATTTTCCCCTTATGCAGATATCATT
GATGTGCCTTTCCATTCAAAAGGCTCAATATCTTTTTTTTCAATTTCATTAAAAAAAATT
TAATTTCAGTAGTTTTTGGGGAATAAGTGGTTTTTGGTTACATGGATAAGTTCTTTAGCA
GTGATTTGTGAGATTTTGGTGCACCCATCACCACATCCCTTGATTGAGAGCTAGGGTAGA
GGGAGCCCTATCTTCTTGGCCACCTTGGTCTAGAGTGGAGCCTCCATAAAACTTGGCTGG
AAGGGATGGGGGGAGAGGTCAGATCATGGCTTAAGTGTCATCAATTTCTGCTGTTCTTAC
TGAATTTTAGTAGATTTTCTTGAACAAATGTTTCTTCATTTGCTGTGCACTCTCAGAATA
AATTTCTAGAGACTTTAAATTATTTTTAAAACAGTTTTCACCCACTTATGCTTATTTCCCTA
GGGAGAACGTCCGCAGAGATTATCATGCTATCATCCAGGAAGTGAAACTCTATGTAACTT
CTTTATTAAATTCTATATGTATTAATTTAAAGACATTTTCAGATTATTATGTAACTTTCA
TCTTTTTCTCAAGTGAATTCACCTCCTAGTTGTTAATTTAGGAAGTCTACTGATTTTAT
GTTTGTTTCCTCATATATTTTGGAATGTTAGCTTAAAAGCTCATCTTTAGTGGGAAGATC
TGTCATTCTCTTTGCAGTCTAAGTTCTATGATTGTCTGTAATAAATCCTTCTGTGGCATC
CATTTCAGATCCATGTCTTCTATCACCAGCTTTGGGTTGTTGTCTAATAATGATACAAGT
CATATTGCAGATCCAGTCACTGAACCAGTGGGTACTTTTGCCCAGGTCCCATTTCTGAGG
TTGTACTTCTTCCTGTCTCCCTACGTATGCAGCTTTATACAATTGTAATCATAAGCGTTT
GCTGCGACATTTGTGTTTTTGGCTTTCTCTCTTAAGTGCAAAAACTTTACCTCAGCCCA
CAGTTTCAAGCCTTAAATATAGCTCTGGTTCCCTTCCTCATCTAGGGTACTTTTAGACAC
CATTACCTGCTATCTTATTTAAATTCTTACTACTTTATATTTCTTTTCTGTGTCTAGTCC
ACAGACAGGTTACCCCTTTTTGTATGTGTATGTTTGTGAGGTATATTCGTGGCTATATTT
GTATGTGTGTATTTTTACATATGCTATTACATGTGTGGAGAAATGTTTCTGAATCATG
ACCTTATAATGTCAGAGTTGCAAGAGTCTTCACATAGATGTTAGGATAAAACATTCACCC
AAGATGTGACTGTAACCAGCAAAAGGATCCGTCCGGCTGCTAGCTGCTTATGAAAAGAAT
TCAAAATAATAACAAATTATGATAAGAAAGAGCAATATTCTCTTATTATCTGTGCCAGCA
AGGGGAAGAGCAGAGACCCATTCTACTCTTCAATTTGTGAAGGAATGCGGGGGTTTTA
TTTTATTTTATTTTTATTTTTTATTTTATCATTATTATACTTTAAGTTTTAGGGTACA
TGTGCACAACGTGCAGGTTTGTTACATATGTATACATATGCCATGTTGGTGTGCTGCACA
CATTAACTCGTCATTTAGCATTAGGTATATCTCCTAATGCTATCCCTCCCCCCTCCCCCC
ACCCCACAACAGTCCCGGAATGCGGGGGTTTTTAAAGAAAGGGTTTGAGATGCAGAATAG
GCAAGAGGGGCTAGGAGGTGCCAGGTGGTGTGACTTGCTCCAGTGGCCCCTCTTGAATTA
TTGTCCCATGTGGTGAAGGGGCTGGTGCCATCATGGATCCTGCCAGGTTATAAATTAGTT
GCAGTCAATCTTGTAGTCACTCTACAGCCTGAAGTAGGTTCTGTTCTTGAAGTAATCTTG |

TABLE 17-continued

SEQUENCES

| SEQ ID NO: | Human Allele | Nucleotide/Amino Acid Sequence |
|---|---|---|
| | | TTGGGGAGAGAATTCTAGAGGTACCTGGTCCCTATCAGGATCTGACTCTCGAAGCTTCTA
AGAAAACATATGACCACATAAAAGAACATGGCGTGTACTTAAAAAGCATTTAGGTAAATA
AATGTGCATAAGGTATGGGAATATAGTATGGGAAAGGAAAGGCAGTGGAGGCTCACAGCA
CATTCCAAGGCTGTATTTCAAGATAAGAGGTAACACATATGCAGGTTGTCTCAAAGTTGT
ATCTTGAGACTTGGAGGGGAAAGAGGAAGAGGAAAAGAAGAAAAAAATGTTTAAACACA
GTTCGAGGCTCAGCTGCCAAGCTGCTTGGTTACATGACTGTACACATCCTTATTAGATAT
TCCTGTAGGTCATCAGAACAAATTTATTTTTCAGTTTTATGTAGTGATATGTTTTATTAT
TTTTCTTTATGTCTTTTAGTTTCCTGTTTTGCTAAGGAAACTCTCTGTACCCCACATGAT
AGCAAGTTATTTTTCAAATTTTTCTTTTAAAATGTTTACCCATTTATTTTTACATCAGAA
TGTCATAAGATTATATATTTTATTTTTACTATATTATGGCATTGTGTACCATTTATTAAA
TAATTTATTATCTAGCCATTGAATTGAAAGAGCACATTTAAAATATATTAAATCCCCATG
TAAATTATATTAAATCTCCATGTAAGTTTTATTTCTGAATTACTTGCGGAGTTTTGTACC
AGAACCATACTGTTTTGATTATGTATCTTTGTAACAAGTTCAGTATCTGTTTCCTCTAGT
AGTTTTCCCAGAATTATATTATGTTGAGTTTTTCCAGGAGCAGTTTCTAAAGAGAAAAAA
GAGTAATAATGTCAAAGGCTTATTCTCATGACAAAGAGAAAACCAAATAGCATTCAAACT
TCTTTCATCTTAAGTGACATGTCCAGGAGGAATATTAATTCTATTCTGGGCTCTCTGTGT
TAGGCCTATGAGCTCCATCAGGAGAACAAGAAGCCCACGAGCCAGAGAGTTCAAAGTGTG
GAAATTGACATGTTCTCTGAAGATGAGCCTCATCTGACCATACAGGATCCCCGAAAGGTA
ATTTTCCTAGGATGTTGTCAGAGGAACTTGTGGCTCATCCACACACCTTCTCCAGGATAG
TTATTATGGAAAAATGGCACAATTAATGCAGAGAAAATTGCAAGAATCGAGTTTTGAGCA
AAAGTCTAGGCCAGGTTTCTCAACTTTACTAGTATGACATTTGAAGCAGGACAATTATTT
GTCATGGTGAGCTTTTCTGTGAATTGTAAGATGTTTATCCATATCCTTGGCCTCTATGCA
TTTGATGCCAGTAGCATCCGCCAGTTAAGGTAATGAAAAATGTCTCTAGACATTGCCAAA
ATGTCTCCTGGAGGGCCAAAGAAATAAGAACCACTGGTCTAGGCCTATTATTCCAGGAGG
TGAGACAGTGGAAAATTATAGTCTCAGTAAAGTAGCCTTCTTCTCATCACATAATTGGAG
TTAGGCAGCCTATCAGGGTTATGATCTGTAGGGAGAAAACGTGGAGGTACTGTATCTTCA
TATGCATTGCTATTCCTCAGCTATAGAGATGAGCTAGAGAGTTCTCTTCTGAAGTCAGGC
TGGTCATAGCACTTAGAAAAGGACCCAGCAGGAGGGGTGTTTCTTGACACCTCTCATCCT
AGAAACCTTTGCCTAGTTCATTTCATCCTTAAAAAATCAGACAATGAGAAACTCCGTACT
ACTATGGTGAAAGAAGGTCTTAGTAAAAGGCACCCCCTTCGTTTTGTTCTGATGTGCAGA
AGTCTGATGTTACCAGTATACTATCAGAATGTAGCACCATTGATCTTCAGGATGGCTTTG
GATGGTTACCTGAGATGGTTCCCAAAAAGCAACCAGAGAGATGTTTGCCCAAAGGTAAGT
GGCAGTATTTCTGCATCCAGTTCACAGAATCTTTGGATGGGGTTTCTGTTCTTCTTTGAA
GCTCTGTGGTTTTAGTAGATATCATCTTTCTACTTCTATTGGAGACAAAAGCAATGAGAG
GGCACCCGTAGATTCTTGAGGCGATTGTCGGATCTAGGCAGAGGGGATTTCAGGAAATTC
TTGCTTTAATTGGGCTCCTCTCACATGGCCCAAAATGCCAGGTAAACACTCTGGAAACT
CTCTTAGAAAGCCCACTGGGCAATATGTCTGCCACTTTCTATGGTTCCCAGGGCATTCA
ATGTCAGGGTGTATTTGAGGTGAAAGACCAAGAAAAGAGTTTAGACATTGTAGTCAGGAT
CTTTAGCTTAGAAGCCAGACTGCCTGAGCTCAAATTCTGGCCTTGCCACTTATGAGCTGT
GTGACTTGTTCAATTTAGTTAACCTCTCTGTGCTTTATTTCTAAAATGAGGGTAATAATA
GTATCCAAAGCAAAGAGTTGTTGTGACTATTAAATGAGTGAATATAAATCACTTAGAAGA
GCATCTGGAACAAAAATAAGCAATCAATAAATGCAGGCTTTCCTAATTCCTTGAGTGGAT
ATAGTGGCTTTTTCCTATAGGCCTTTACTATTTGTTATATTCATTGTAGTGAACTTATTT
GCACTGGTTTCCCCCATGAGGTCCTTAAAAACAAAGGCAGTGACTTCATCAGCATTGTAT
CTCTAGTGTAAGAATAGAAGCCGGCCCAGAAATGGGTTCAACAAATGTTGATAAATAAAT
AAGTGAAACAAATTAATGAATGAATCTAAAAAAATTATCTATAAGTTTAGGATTAAATTG
GGTCCAGAAGCAACACAAATAACAGGTTTCAAACTCACATTCCAGGTTGCTTAACAGCTC
CAAAGCTGGACAGGAGTTGGATTAAGGATTTCCAGTAGATTGCAGTTCTCCTCATTTATG
TTTGCACTGGCTCTTGAGGTGTGCATATGATGTCAACAGTGGAGATGAGAAAGAAAGGTG
GTTTTATCAAAGAAGGGAGGAGTGGGATAAAAGCCAGGAAAAAAGTGTAGTCTTTTAGGA
AGATGAACCTACTGATGTTTTGGAAGAAGAAAAGAGGCAGAGTGAAGAGAGCCCATAGT
GGTTTAAGAAGATGAGGAAAGGAGCAGAATGTTATAATCATCATGAATAAGGATCAGCAG
AATTTGTACAAGGGGAGGAGGAGAAAAGGTGGAAAGGGCAATGTGGTCTATATTGAAGGC
CTGTGTGTGTTCAGAACAAATGCTCAGCTCTTTGTAAACGTCTCGACATTTGATCAAATT
CTTTCGTGTATGACCTGAGAGGTTCACAAAGCCTGTGGCCATCCTACCTCATTCCCTGGA
GTCCTCCAGACATGATCTCTTTATGATTACCAAAAAAATTGCTGCATAACAAACAACTAC
AAAACCTCAGTGGCATAAAATAGTAAACATGTGCCTGCAGGATTCAGCTGATCTTGATTG
GCTTCATTCATGCAAGTGTTATCTAGCCTGGGCTCAACAGGGCAACATGGCTCTACTCCA
CATGTCTATCATCCTCCTTCCAGACCCAATGGGGTAGCCTGAATTTGCCTTTTTTTATGG
AGATGGCACAAGACAGCAAGTGGAAGCATGCAAGGCTTTTCAAGACCTGGGCTCAGAACT
GGCACAGTGTGACTTCCATTCCACTCTATTGGCTAAAGCAAGTCACATGGCAGGGACCAG
ATTTAAGATGTTAGAAAAGATGCTCTACTTCTTTAATGGGAGCAACTGCAGGTCGCATG
GCAAGGGGCATGAACACAGAAGGGGTGAAGAGTTGCATTTTAATGCAGTTTATTACAGA
CACTAATGATAGTGCTACCATTAATTCCTTTCAGGCTTTGGTTGCTGCTTTCCATGCTGT
AGCGTGGACAAGAGAAAGCCTCCCTGGGTCATTTGGTGGAACCTGCGGAAAACCTGCTAC
CAAATAGTGAAACACAGCTGGTTTGAGAGCTTTATTATCTTTGTGATTCTGCTGAGCAGT
GGGGCACTGGTAAATCATCATTGTCTTGTGGAGACATTGGGCATCAGGGCAGCTGGGGAA
GCTGCACTCTGACTTGGCTTCTCGTGGGACTGTGAATATGGGAGACCAGACAGAAGTGGT
TCTCTGATGCTGCTGGTTCCCGCAGTGGGCAGGGTTTTGCCAGCTTCTGAAATCGTGCTC
AACTGGGATATCACCAAGCAAAGATGCTTTATCTGTGTGGAAGACTAACTAAAACCAGCA
CTTTAAAGTGGCCACTAGAGTCTGGTCCTTGATCATCTACCTCTCATTTTTGGGGGATTT
CTAGACATTTTCACTGTATCCTACATAGTTCTTCCTCTAGACAGCAGTGCTTCTACTCTC
CCTGTTACCATAAGCCATAGTGCTGTTTTCTGAAAGGTAAAATATTATGGGAGGGAGTTA
CAGGGACCAGATTAGGATATAATAAGTTGCCTTGGTATTTTCTGTCATTCATGATCCCTT |

TABLE 17-continued

SEQUENCES

| SEQ ID NO: Human Allele | Nucleotide/Amino Acid Sequence |
|---|---|
| | GAAAGAAAGGACAAGGAGATGTTGCTTTATATGCATGGTCAAAGTGTGGTATGAGTCCCA
ATGAGATTTAGAAATAACTCTGAACCCATCAGCTTCTATAGCCATAGAGCTATCCACTCC
TTTATGCTCTCTCTCCACACCTTCTGGTCCTTCTTGTCTCCCTTTCTCCTCCCTGCTAGG
GAGGGATAGTATCTTTTCTCTTATCACCTGCATATTTCGCCCTCTCCTTTTCTATTTTCT
GCTTTTTTCTATCATGCATCTTCCCTTAAAATGATCATACAGTAATGTGGAGCTAAATAA
TAGGGAACCAAATTCTCTTACTGTTTGACATAACAAAGTTATGAGTTTGTTATGAGAGTT
TGGTTCCATATTACTAAACCCAGGAGCCTTGGGTTCTCCCCTGCTAAGAGTGACAGAACA
TTTCACAGTGAATCACTAGCAAGTGGAAAAGACAAGGAAATGTCTTGCTCCTACACCCC
ATAGCTTCTGGTTAGTGTTTTACACTTGTGTGATCTCTAGGTGAAAAGAGATGAATACAT
ACCAGAGCCCACCGGGGACTGTGATCAACATACATGTCCATTTGTCTACTTACTACAGTG
TAAATTATTCTTCAAATAGAAAAGCAGATTTCTCTAAAACCATCCCAGAGAATTCCCTTA
ATAAATTTTTATTGTTAATCTTGGGTCTAGGGTTACCTGTAGACTTTCTGGTGACTACAT
TTTCACTGGCTGTCTACTGTTACTCAAGTGTAGGGTTTCTTGTATTTATTCCACAAATGG
TACTTATGATATAGGCAGTGGGAAAGCAGTGACAGTGCCAAAAGGCCACAGCAAAAATGC
CCCATGGTGCCATAAAAAGAAAATGTATGATCAGAAATGTAGCAGAGGGCACACAACTCC
AGTTCTTATCTGCCTTCGGAAAGGCAGGTGTAGGCTGGGCAGAGCAAAGCTGAACACACA
ATGCAGAGGGTGCCAGGGGAAGGACCCAGCCCATATTTCTCTGTACATATTTGTAGAGAA
TGAGAACAAGAGACATCAAGTTGTTTGCCACTATATGTGTCTATCAGCAGCAGCAGCAGC
ATCACCTGGAAGCTTGTTAGAAACGCAGAGTATTACATTGTAACAAGCAGTCCATTGTAA
CAAGTTCCCTAGGTGATTTGGGGTTCATTAGAGTTTGAGAAACTCTGGTCTAGGCAACTA
TGTAATAATAAGAGCTTCCTGTGTCAGAAAATGGCCTAGATATAATGTGGAAGCCTCTGA
AGCTCAATTGCAGGTATAAGCGTGCTCATCCATTGAGCTAACTCAGATCTGCTGAACCAG
CTTACTGGTAAGCTTCCCAAATAAGGGAGGAAATGAGCACCCAATACCATTCAGATTTGT
TTATCCTCAAGAGGCAAACAAACGAAGTCCCTGACCTCCAGGAGCCTGAAGTCTAGTAGG
AAAGACAGCTGGAGTGATTATAGACCAGAAAGTATAGATCAAGATAGATAGAACAATTAA
GTGGTCTACTCAGGGAAGCAGTGGGTGACATGGGAGCATGTAGGATGGGAACCTAACCCA
ATCCTGCTGGAACGGGACAGTTTCCTATAGAAAATATCAGCTAAGCTGAAATCTTAAAGC
TGAAGAGCTGAAAGAGCAGAGGATGAGATAGAGGGCCTTCTTCAGCCAGAAACCAATTTG
GCAATTGGAAGTGAGACTGTTTTACTCTTTTGCATTCTTTTTTTCACCCCAGGACTTTGG
AGCTGTGGGCTTACCCTAGTCTCCAACAGCAAGGATGATTCCCTTCCTGCCTTCAATGTT
GACGTAAATTTCATGGGCAGCTTTAGTAACAGGCCGTCTTCCTTTCTTTCATTCTCAGTA
ACTCTGTAAAGGCCAAAAGGACAGCTTATACGCTAGTTATATAGACCCTGTAGAATCACA
TACAGTTTGCGTGAGGGAAGTGTTTGGATGTAGCATTAAAAAGGGTCTCTCTGAAAGCCA
GGATCTCTTTTTCATAATTACAAATAACAATGTTTAATATTCAAAGTAATTTACACTGGG
AGCTTTAGCCTAGAGTGTTCCAAATTTTGTTAATGTCATGGCACACATAAGAAATGACAC
TATTTGTAGGGAATGGTAAGGTAAATGGATAAGGCTGTTTGTAGGGATAGATGAGGGGCA
TCAGGGTTGGCAGGATTTAGAGAACGGGCTAAGGCACTTGGACTTAATGTTATAAGCAAT
AAAGAGACACTGAATTAATCCACCAAGGCAATTGGGAGGATGAGAGATGGTCTATGCCAC
TGGGTGGTCCTGGGAATGTTGGCAAGACATATTTGGCAGGAGTTGAAAAGATGAGGAAGC
CCAGGAAATAATGTGCTGATCCATTAGGAAGATGTTTTAATATTCAGGGGACCAGTAATA
AGCAGTTGAGGAACTATTGTGACAACAGAAGAAAGAAGATTTTCCTTCTTCCATTTTTAC
TTACTCAAGGAATGGATTCCATTGGAAAAGTTTAGCCTTAATATCTTTTGAGCAGAACCT
CATTACGAAGAGAGATACCAGTTTTTATTCATATAAGGAAGAAAAACAAAAAGTAAAGTT
ACCAAGGAGTTCTTTGCAAATATTCAACCTGGCCTATGGCTATGCTTTTTCATTTCAGAT
ATTTGAAGATGTTCACCTTGAGAACCAACCCAAAATCCAAGAATTACTAAATTGTACTGA
CATTATTTTTACACATATTTTTATCCTGGAGATGGTACTAAAATGGGTAGCCTTCGGATT
TGGAAAGTATTTCACCAGTGCCTGGTGCTGCCTTGATTTCATCATTGTGATTGTAAGTTT
ACCATCTCTGTGTCCCACACAGGCTGGGGTAGTGGTTAAGGCAGGGATCATATGGAGGCT
GCTTTTCCTGTGTGCCGCATATGGATGTCTGTCTAAAATAGTTTTTCTTGTTATCATTGC
CTCTTCACAGTACTTGTAAGTAGTTGTCATTTGTCTGTAAGCAGTTTAGCCTTTCCTAGG
TCCCGCTCATCATACACTACACTTTATATGCTCACCACTACAACCTTTCCCATGATGGGA
TTCATTCACTTCTCTCCATAAGCACTGTTTATGTATAATATGTACCTAGAATAACTTTCA
GTATCCTCGATTTTTCTTCTTCCAACTTTCTATTTCTTTTCAAGACTTCTCAAAGCTGG
TCAGCAGCCAATAGACTAGGCTAATATCCATCTTAATTGTCAAGCAGCATAAGAGGATTG
TTCACATACAGTCTCTCATTTAATATGCATGACAATGTTCTGAATTAAGCAGCATTGTAT
GACACCTCCCACACTGTATACAAGGAAACCTGAAGCTCAGAGGATTATCAATTTGTTTCA
GGTCATAGAGCTGATAAGTGGTGAAATTGGGATTCACGTGTCTAGCTGTATGACACAAAA
GCTAATAATAGTATTAGTGGATCACATTTATTGAGTGCTTTCTCTGTATCAAGTACTCTT
CCATATGCTCCAAATGCCTTCTCTCTTTTAGTTGTCATAGCCACTCTGTGGCAGGTGCTA
CTATTTTGTATATTCAGAGAAAGAAAGTAAGTCATAGAGAGGCTAAGAAACATGTTCAG
GATTGCCCAGCTAGAAGTGGTGGAGGTGAGATACAAACCTCGTAAGCCTCACTCCAAAGC
TCTTGATTTAACATTACATCCTTTTTTAAGATTAATTTTATGTTTACTGATACATAGTA
GATGGACATATTTTCAGGTACATGTGATTATGTAATACCTTTATATAATTAAAACTGGT
GCAACCTAGTAAGTCTCACTCCAGGGCCCTTGATTTTAACATTACCTCTTTCCATCATGA
TGTAATTAGTTAAACTTTGTCCCTGCTATGCAAGGAAGTAGATAAGACAAATATCTGAGC
ATAAACCATGTGGTCAGGAAACCCCACTGGAGAACCATAATGTTGTTGGTTAGCACAAAT
AGACCATGTGTTCATTTAATATGGACATCAATATTCTGAGTTAATCAGTATTACATGACA
TCTACCACATTACTAACAAGAAACCAGAGGCTCAGAGACAAGGAAACAGAAGCTCATTG
TGGTTCAGGCATTTTAGAAAGGTATAAATGCCATAGAAACTACAACAGGATTCAAGATG
GGAATAAAAACATCCACGTTTGTCAGTCCTATTAATTTCTAGAGAGCAAATAACTCTGTA
CGTATTATCTTAATAGATTATAGTAAAAGAAAACCCTAAAAACTGTGTGAACAGATGAT
TGTTATCTCCATTAGGGAACTCTGTTTTACCGGATACAAGCCCTACATTTAGGAGCCT
GGGTCCTAAAGCTAATTGGTCTACCCTCTTTTTGTGTAACCTTAAGCAAAACATTTCCCC
TCTTTTGACAATAATTTTCTCACAGGTAAAAATGAGGATGTGGACTATAAATTGCCCAAA |

TABLE 17-continued

SEQUENCES

| SEQ ID NO: Human Allele | Nucleotide/Amino Acid Sequence |
|---|---|
| | TTCACTGAATACATAATAGAAAGCTAGTGATAGTTTCACTAGAAATCTAGTGATCGCCAT
TAAAAATATCAAAACAGTTGTCCAAAGCCACACTGTCAAAAAAGGGTACCAGGCTGAGAT
GGGTGGGTTTATTTATTTATTTATTTATTTATTATATTTCAATAGGCTTTCAGGGAACAG
GTGGTGTTTGGTTACCTGAATAAGTTATTTAGCGGTGATTTCTGAGATTTTGGTGCCCCA
TCGCCCGATCAGTGTACACTGTACCTAATGTAGTCTTTTATCCCTCACACCCTCATTTCC
CCTGAGTCCCCAGAGTCCATTGTATTATTCTTACAACTTTGTGTCCTCTTAGCTTAGGTC
TCTCTTATGAGTAAGAACATAAAATGTTTGGTTTTCCATTCCTGAGTTACTTCACTTAGA
ATAATAGTCTCCAATTCCATCCAGGTTGCTGTGAAAGCCACTATTTTGGTCCTTTTTATG
GCTGAGTAGTATTCCATGGTGTATGTATATAGTATATACCAAAGACTATATATATATGGT
ATATACACCATATATATACCATATATATAGTATATACACCATATATATACCATATATATA
GTATATACACCATATATATACCATATATATAGTATATACACCATATATATACCATATATA
TAGTATATACACCATATATATACCATATATATAGTATATACACCATATATATACCATATA
TATAGTATATACACCATATATATACCATATATATAGTATATACACCATATATATACCATA
TATAGTATATACACCATATATATACCATATATATAGTATATACACCATATATATACCATA
TATATAGTATATACACCATATATATACCATATATATAGTATATACACCATATATATACCA
TATATATAGTATATACACCATATATATACCATATATATAGTATATACACCATATATATAC
CATATATATAGTATATACACCATATATATACCATATATATAGTATATACACCATATATAT
ACCATATATATAGTATATACACCATATATATACCATATATATAGTATATACACCATATAT
ACCATATATATAGTATATACACCATATATATACCATATATATAGTATATACACCATATAT
ATACCATATATATAGTATATACACCATATATATACCATATATATAGTATATACACCATAT
ATATACCATATATATAGTATATACACCATATATATACCATATATATAGTATATACACCAT
ATATATAGTATATACACCATATATATACCATATATATAGTATATACACCATATATATACC
ATATATATAGTATATACACCATATATATACCATATATATACACCATATGTCTCTTTCTCT
CTCTATATATATATCACATTTTCTTTATCCACTGGTTGATTGATGGGCATTTGGGCTGAA
TCCATATTTTTGCAATTGCGAATTGTGCTGCTATAAACGTGTGTGCAAGTGTCTTTTTCA
TATAATGATTTCCTTTCTTCTGAGTAGATACACATTAGTGGGATTGCTGGATCAAATGAC
AGATCTACTTTTAGTTCTTTAAGGAATCTCCACATTGTTTTCCATAGTGGTTGTACTAGT
TTACATTCCCACCAGCAGTGTAGAAGTGTTCTCTTTTCACCACATCCACGCCAACATCTA
TCATTTTTTGATTAGTGCCATTGTTGCAGGAGTAAGGTGGTATCACATTGTGGTTATGAT
TTGTATTTCCCTGATAATTAGTGATGTTGAACATTTTTTCCTATGTTTGTTGGCCATTTG
TAAATCTTCTTTTGAGAATTGTCCATTCATGTCCTTTGCCCACTTTTGGATAGAATTATT
TGTTTTTTTACTTGCTGATTTGATTGAGTTCTTTGTAGATTCTGGATATTAGTCCTTAGT
CAGATGTATAGATTGCAAAGATTTTCACCCACTCTGTGGATGTCTGTTTACTGTGCTGAT
TGTTTCTTTTGCTGTGCAGAAGCTTTTTAGTTTTAAGTTCCATCTATTCATCTTTGTTTT
TGTTGCATTTGCTTTTGGGTTCTTGGTCATGAAGTCTTTGCCTAAGCCAATGTCTAGAAG
AGTTTTTCCCATGTTATCTTCTAGAATTTGTATGGTTTCAGGTCTTAGACTTAAATCCCT
GATCCCTCTTGAGTTGATTTTCATATAAGATGAGAGATGAGGATCCAGTTTCATTCTCTT
ACCTGTAGCTATCCAGTTATCCCAGCACCATTTGTTGAATAGGGTGCTCTTTTCCCAATT
TATGTTTTTGTTTGCTTTGTCGAAGATCGGTTGGCTGTAGGTATTTGGCTTTATTTCTGG
GTTCTTTATTCTGTTCAATTGGTCTGTGTGCCTATTTTTATACCAGTACCATGCTGTTTT
GGTGCCTATGGCCTTATAGTACAGTTAGAGGTCTGAAAATGTGATGTCTCCAGATTTGTT
CTTTTTGGTTAGTCTTGCTTTGGGTATGCAGGCTCTTTTTTGGTTCCATGTAAATTTTAA
GATTGTTTTTTCTAGTTCTGTGAAGAATGATAGTGGTATTTTGATGGGAATTGCATTGAA
TTTGTAGATCGCTTTTGGTAGTAGGGTCATTTTCACAATGTTGATTCTACCCATCCATGA
ACATGAGATGTGTTTTCATTTGTTTGTGTCATTGATGATTTCTTTCAGCAGTGTTTTGTA
GTTTTCTTTGTAGAAGTCTTTCACTTCCTTGGTTAGGTATATTCCTAAGTATTTTATTTT
ATTTTATTTTCAGCTAGTGTAAAAGGGGTTGAGTTCTTGACTTGTTTCTCAGCTTGGTCA
CTGTTGGTGTATCACAGTGCTACTGATTTGTGTACATTGATTTTGTATCCTGAAACTTTG
CTGAATTCATTTGCCAGTTCTAGGAGTTTTTTGGATGACTCTAGGATTTTCTATGTATAC
AATCATATCATCAAGAGGCCCAGATGGTTTTGCAGGTAAGTTTTACCAAACTTCCAAGGA
AGAATTAATCTCATCTTATTCAAATTGTTACAAAGAATAGACAAAAGAAGGAAAGCTTGC
AAATTTATTTAATGAGATAAACATAATATTGATAATAAATGAATAGAACAGAAATGAATC
AAATAAGAAAATAATCTTACAATTATATATCTTTGCAAATCACAGATAAAGCACTCAACA
AATGTGGTTTACTATTACTATTATTAGCCTTGACATCATGCAGACTGTGGTGTGAATCTG
AAATTCACCACTTATCAGCTGTATGACCTGAAACAAGTTGCTGATCCTTTGAGCTTCAGG
TTTCCTCATCTATAATATGGTAGATGTTGCAAAGTGCTGCTTAGCTTGGGATATTGTTGT
ACAGATTAAATGAGAGAATGTATGTGAACAGTTCTATAATATTTATTGTCAATCAAGATT
ATATAAAATTACCATCATAATTTTTATTAGAAAAGCATAAACCACAAAAAGATACACAAT
TCAACTACATCAAAATGTAGTAAAACTTTTATTTTTGTATTCAACAATACTCTAATTACA
GTTACAAACCAACTAGAACCTGGGAGACAGTATTTTCCACAACAGATCATTATTATTCAC
AACATATACAAATTTCCTACAGATTCACAGGAAAAAACAACCCAGAGTAAGAATGGGAGA
AGTATACAAACAGCCAATTCACAAAAGGAATAAACGTATGATGAAATATACACTAGTTCT
ATCACCAGTTAGCACAGAAGTGCATATTAAAATGAGAGGCCTCTTTTTACTCATTAGATT
GGAAAACAAAATATATTGTTTTGAAACATGGTCTCACTCTGTCATCCAGGCTTGAGTGCA
GTGGCAACCTCTGCCTCCCAAGCTCAATTGATCCTTTTGCCTCAGACTCCTAAGTAGCTG
GGACTACAGGCGCCCACCACCATGCCCAGCTAATTTTTGTATTTTTTATGGAGACAGGGT
TTTACCATGTTGCCCAGGCTGGTCTCAGACTCCTGAGCTCAAGCTATCTGCCTGCCTCAG
CCTCCCAAAGTGCTGGGATTACAGGCTTGAGCGACTGTGCCCAGCCATGGCAAAATTTTT
AAAGTTGGATAACATCGATATTTAGAAGGATATAGGAAAATGCCATGGCAAAATTTTAA
AGTTGGATAACATCGATATTTAGAAGGATATAGGAAAATGCATCTCAAACCACTGCTAA
TAATTTAATTGGTACAGCCACTGTAGGGAATATTTCGCACTATATTAAGTAAAAATCACA
AATGACCCAACTCACAATCCACAAATATCACTTGTTATAGATCCAAGGAGAACTCTTGCA
TATGTACCCAAGAAAATGCACACATCTGCCCAGTGTACTGTTGTGCATAATACTGTCCA
GTGTACTGTTTTGCATAATAGGAAAGAAATGGAAATAACCTAGGTATTCACCAAGGAGGA
ATGGATCCGTAAAACATGAAGATTTATATGCTGTACTATTCCTCAACAGTTACAAGGAGC |

TABLE 17-continued

SEQUENCES

| SEQ ID NO: | Human Allele | Nucleotide/Amino Acid Sequence |
|---|---|---|
| | | AAACCATAAGAATATAATCAACATGATGATTTCAAAAACAGTGCAGAGTGATAAATGCAA
GTTAGATTTTAAAAATAAGATAAAACTAGTAGAAGACTTCTCACTTGAAGAGTACAGTAT
GGTGGGAAAGAATGTGGGTGTTTCTATGTGTCTCACTGATACCTGCAAGTCTGATGGAAC
AGAAACTTGGGTAAGGTTTAAGGTAAAGAGGTGTATAAGGTCTCTGTAGGAACATCCCTT
CTCACCAACTATGACAATGATTTGGTAAAACAGAAGAATTGCTAAACTTTGCCATCTGTT
TTCATCTGGCTAGGAATAAGTGGAGTATTTGCGAGAAAGCTACTTAATAACTTAATAACT
TAAATAACTCTCCAAAAGTGGTGCCATTGTAAACAAAAAGCCCACTAAAAACATTATAAA
TACACTGTAAATTGATTATAAATTTCAAAATCTTAATATTCTGTCATATTAACTCAATTT
CTCTTCACTACTACAATGAGGTTGGCAAGATTTGTGAGGAATGTTTTTAGGTAATAGTGA
ACTCTGACATCAGCTTAGTCAGGACTATCCTGATTCACTTCCTATCCAGCTGAGCAACTC
TTCTTCCAAGCTGAGCCTCTGAAAACTCTCCATAATAAGAATGGCTGAAGATCTGCAGCA
AGCAGATTCAACTCAAGCTCAGCATTGATTCCATTGTGATAATAGAAGCAAATCCTAATT
CCTCATATGAAAGCCAATACCTTCTCGAATTGTCCTCTACTGAGCATCTGTAAATATTGT
TAAGATTTAATTTGGTATACTTAACAGAGCTTTCTAATACTCAGTTCTGTCCTATTGAGA
AGAAGCATATTGGGAGAGAAAATAGCATTTAATTCCCCAATAAGGAGCTATTTGGATTAG
GGGAAATATTAGCAAATAATTTATTTTTTCCATGTAACTTTTTATTTTGATATCATTTCA
AACTAAGAAAAATGTTGCAGGAAATAGTATAATGAAATCCACATATTCTTTCTTCAGGTT
CACCAATTATTGTCACCCATCTGCTTTGTCATTTTTTCTCTCTTTTTTTCCCCCTAAAC
TGCTTGAGATTAAGTTGCAAGCATCAAACCTATTACCCCTAAACATGTCAATGTATATTT
CCTATCAAGGACAATGTCTCACATGATTACAATACAGTGATCAAAGTTAGAAATTTAACA
TTGATTCAATTAAAATCCACATCCATTTTCAAATTTTTCAAATTCACCATAAAGATCTTT
GTTATGGCAATTGACTATCATAATAAATTTCAATTGACTGCCATAACAAGATTCTTTATG
GTTAATTCCCTTTATGCATCCACCTCCTACCCCCACTCCAATCCAGGATCCAATTCAGCA
CCCCAGATTACATGTGATTGTTATATCTCTTTGCTTTCCTTTAATTCACAACAATTTCTC
GGATTTTCTATGTCTTTCACTAAACAAATAACGTGAGTGCATTGTTCCCACGTTATGGA
CTGTAGCTTTGGTAGATAAGGAGAAAAATGGACTTTCCAGCTGGACACCAAGTCAGGTAC
ATTATCTGTGGCCTCTCTTCCCATCAGGTCTCTGTGACCACCCTCATTAACTTAATGGAA
TTGAAGTCCTTCCGGACTCTACGAGCACTGAGGCCTCTTCGTGCGCTGTCCCAGTTTGAA
GGAATGAAGGTACATTCTGCAGAAGAATGGGTAGAAGTTCAGTTAACAGAGAAAGGTGGA
AAGACCAACAGTTCTTTTTGGGCTGAGATTTCCTTAAATTGCCAAGCTTTTCCTGGGTTA
CTTCCCAGCCTGCCCAGTGCTTAGAATTTGAGGGGTAGAGAAAAGCCTAAGATATACTTT
CTACCCTAAAAGCTTCTGTGACAGCCAAGATGAGCTGTAGCTTTGCCTCAGAATCCTGGG
GTAGGTGTCCATAAGTCTCTAACACTGTCATCACCAGGGCACTTCTCAAGGTATCCTCAG
TGGCAACAGAGAGGACCCATTATGTAGGGAGCTGAGAGCAGGGCTTGTCATGGGATGGG
GCACATGTATGTGGAGATTAAGGACAGAGCTCCAAGAGATCAAGCCCTGCACATCAGGCC
CATGCTGAGAAGTTGAAGAGCCTGGTGCATCCTACCCATCTGTTATGGTTTTCTTTGCTT
TTGTTTCCATAAGGTGGTGGTCAATGCTCTCATAGGTGCCATACCTGCCATTCTGAATGT
TTTGCTTGTCTGCCTCATTTTCTGGCTCGTATTTTGTATTCTGGGAGTATACTTCTTTTC
TGGAAAATTTGGGAAATGCATTAATGGAACAGACTCAGTTATAAATTATACCATCATTAC
AAATAAAAGTCAATGTGAAAGTGGCAATTTCTCTTGGATCAACCAGAAAGTCAACTTTGA
CAATGTGGGAAATGCTTACCTCGCTCTGCTGCAAGTGGTAAGTACAGTCAGTATGTTTTT
CACTCTGAGGAGAAAAACCTTCAGAGAATCATGAATTGTTTCTCAGCTAATAAAAATGCA
GTGACTCCATTGTGATAATAGAAGCAAATCCTAATTCCTTATATGAAAGCCAATGCCTTC
TGGAATTGTCCTCTACTGAGCATCTGCAACTTCATTGACTGCTGAGCCTCAGCTTCCTAG
TGATGCCCCTTTAAGGATCTGTACATCTCACCTTGTCCTGTATGGCACCTTGCTGGCTCT
CCACATCTCCAGGCAGAGAGGAGTGGAGCCTCAGGTGTAGGTCATGACACTTTGAACAGT
TCCCTGTTTAAAGCACAGTTGCCAGGTCTTGAACAGGCAGTGCAAATACATATGGCATCA
GAAAAGAACCCTTTAACTCTTAGCCAGTCTCTTTTCAGCTGTTGGGCCACAGCTTCAGCC
TCTCTGGTAACTTTTAAGGTGGAAATTTCTTGTTTTTAAACTTTGTATCTTGTACAAATG
AAGAAGAAGAAAAAAATCCAAGACACACACCCTTGAGTTCCCTTCTACTGTTCTTTTATT
TGAGCATCCTGTCCTAGAAGGTTGGGGTATCATCTTATATATTCAGCCCACTGGGCCTCA
CCTGCTTTTCCATGCCATGTATCTGTTGATGGCAAGTCTACATTTGTATTATTCATGTTT
TTCTGCTTTTGTTGCAGGCAACATTTAAGGGCTGGATGGATATTATATATGCAGCTGTTG
ATTCCACAGAGGTGAGTCAGTGTTCTACCATGTTCTGGAGTGTTATGGTCAAGTCAGAGA
TATCATGACTACATGGACAGTCCAGAACTGGCGTCATAGTTCCAGCAGCTGGGGTTCTCT
GCCTTGTTTTCTTTGGAACAAAACACTATGAGATACCACTGCCTAATACAAAGGATTCTT
ATGCATCCTCTAGTGAGTATCTGATACCCCAGTATTCTCTGAAGTCCAGTCTTCTTTCTC
CATGGTGGCCAAGGAAAAACCACTCATACAGGAGATGGAGCCAGAAGTGGCAGAATCACA
GGATGCCTTGATTTTCTTCTTCCCTCTTCTCCAAATGGTTGGATAGTCAGAAACCAAATT
TCAAAGAGTATCTGTTTTAGATTGTGGGAAACCTTAAGACTGCACTAAATTTGCAAGGGA
GACCCTCGCATGGCTCCAGACTCCCTAGTGATGGCCAACTGTTGAATTTTAGAGTTTCTA
GTGATGACCAGCTGTTGAATTTTAGTTAAAGAAAAGATAATCACAGATTCCCAAAGTTGG
AATTGCACTCAGTAATCTAGCCTAGTTTCTATTTTCCAGCTTGGAAAGTTGAGGGATAAA
AAGAAAGAGTTTCCCAAAGCCATAGAGTAAGCAGATGGTTGGCTCAAGAATGGAGTCAAT
GGCAGAAATTATTGTTTCCTATTATAGCACATGTGTGTTTCGACCTATTTGGGAGTCT
GCAGAGTTGATGCCTAACACCTAAAAAGTATTCAGTACCTGTGAGCTGGTACAGACTGAG
TATCCCTTATCTGAAATGCTTGGGACCAGAAGTGTTTCGGATTTTGGAGTTTGTAAGATT
TGGGAATATTTGCATAATACTTACAGTTGAGCATCCGTGATCTGAAAATCCAAAACGCCA
CAGTGAGCATTTCCTTTAAGCATGACCTTTGCATGTTATGTCGACATTCAAAAAGTTTCA
GATTTTGGAGCACTTGAGACTTCGGATTTTCAGATTAGGGATACTCAGCCTGTAGTAGCA
GTAGAAGTGGTTTGATTAGTGTTATAGCAGCACCGAGGGATAAGAATTAATCTTTATGGC
CATTCCAGTTGTCATTATAAATTCACAGATTGTCATTATAAGTTAATATACAGATGATGC
ATAGCAACAAATCTGAGTTTGCTTAATTCTGGGTGTGTCAATAAAGTCAACTTTCTGGAA
AGACAAAGGTAACAGTAGATACTTAACTGTTTATAACAATTATAGTTTACATTGTAATAT |

TABLE 17-continued

SEQUENCES

| SEQ ID NO: | Human Allele | Nucleotide/Amino Acid Sequence |
|---|---|---|
| | | TTATATATACAATGTAATTTTATAATTATATACAACATAATTTTATAATTACAATTTA
TAGCAAAGGAAATATTTTAAAAATACTAATGTACTCATTTCTTTCGTCTTTTCGAGTACA
TGACCTTCACTCTAGTTTGGCTTTGACATCCATCTGTGCGGAGGTGGAGATGGGGAGTGG
GGAGGAAAGGTTTTGCAGATGTGTAGTAGACAAGGTGTGTGGCTTGCAAATGCTCCAAGA
GTGAGTGACAGGTGGGTGGAAGTGTGTGGAGGGGTGCCTGTTTTGATGCCGGTCCTGATA
TGTACTGGTTGTTGTATGCTGGCTTCTAGCTTGATGACTCTTGTCTATATAGTCACCCAG
CACTCTGCTGGCCTCAAATATTGAAGTTGTGGTTGTTGAAACTGTGAGCGTTTTCCCCGT
CATCTCCTCCTGGCCTTAAATACTGGTACTCTGCCATATCCTCCCCATGGTCCCTGGCAG
TCTACTCCCATCCCTTGCTGCAAGGCCCAACATGACAGGCCCATGGCTATCAACTCCGTG
TCCAAGCCACATGAGAACTGAGAGGTTCAAGAGACTTCTCTCTGTTCAATTATGTTACTC
AAATCTCTTAAGTCAGCCTGCCTTCCTGATATATCTCAGGCCTTCCCAGTAGTAATTCCT
TCCAGGAAATGCAGAAGTAAAGCAAGAATACCCTCTTTGCCTTCCATGTTTCCCTCAATT
TACTGCATTCCAACCCCCCTTTCCAGACCCAAAGAGGGATAATCAGGACACACATCTTGC
AGCTCTGATTTTCTGTCTCTGTTTATTTTTCCTACATTTCCTATGAACAAATTGGGTGAG
CTTTGATAATTTCATCTTCTTGTCTAAATCTCCCTCCAATAAAACTCTCCACCTTCAAAC
CTTTGATTTAACAAAGAGGGACATGAAGGAGTACAGACATTCCTATATCTCAAAGCAGTA
ACCTAACATGCAAGACTATTAGCCCACTTGGCAATTTTATTTTAAATGTCTAATGCTAAA
TATTCTTTCCATTACGTTGTTTCTGTACTAATGTCTACCTTTTGTTCAAATAAATGGATG
CCTCAAGCAAACTTGGACTAAAGTCAGGTAGTCTTCATAGCAAAAGAGAGAAATAATGTT
TTCAAATAATTACCTTCATTACACTAGTCTACATTGTGAGTGTTGAATAACAAATACCAT
AAATGCATTAAACATTAGTCAGAGCTATCAGCACTTATATCTTTGATGTGATAGAGGGAA
AAAAAGTGAAATCTTTTTGCCACCTGCCTGAAAGTGCTTGAAGCCAATAACAATGCAAAG
GACTTGGATGAAAGGGCTCTTAGGTGATTTGGGTTGTATCTTAGACTAGGAGAGCTTGGT
TGGAGTCCATTTGTGTCCATTTTAGAGCTCGATCATTTATTCATTCATTTAGATATTTAT
TCCATGTGTATCAAAAATCTACATATCAGAAGGTATGCTAGGCACTAGGAAGTTAAGAGT
GAAAGGACATTACCACATATTAAGTAAAGCAGTGGGCTCTATATGGGGGTCATAGTAGTT
CAACAACACTTAGTAGTTTAGTCACCTCTGCCCAAGGTGAACGTGCCCCTCCTCTGGTGG
CCTCACCTCCAGTCAGGTTCCCTCCAGTTACATACCCATATGGACATTCCATATGGATGA
CTTTTTAAAAAGACAAATGTGATCATACCACTCATCTCCCTTACAGTCCCTCAATGATTC
TCCTTTGCTTAGAATAAAAAGCCCGATTTTCCATCACCCCAGGTCCCCGCCACATGCCAT
CACTCAAGCTGAGCTGCAAAAACTGAAAGACAGGCTCCCAACAGGGGCTATGGCTGTTAG
GAAGAGGCTATGTAGTCAATGTTGCTGCTAAGAAACACCTTGGTCTTCTAGATAAGGTAG
TTAGAATGCTTATATTTTTCTCCAGTAATTGTTTTTTTCTCTTATTAAAAAAATTTCTAA
CAGAAAGAACAACAGCCAGAGTTTGAGAGCAATTCACTCGGTTACATTTACTTCGTAGTC
TTTATCATCTTTGGCTCATTCTTCACTCTGAATCTCTTCATTGGCGTTATCATTGACAAC
TTCAACCAACAGCAGAAAAAGATAAGTATCTGGGTTGTCTTGATTTGGTAATTTTATCTC
TGTCCTCCAAATGCATTAACAAAACATAATTCTGGCCTAGAATGTTATACAAAGTAGCCT
TTATGATCTGCACAATAACAAGGAGGGAGCCTCCCATGTCTGCCTGGAGATGATCCTCAA
AGATGAGGCTGAAAGAAGACTGAAAACATCTGGGTTTAATTAAGTCATTACTTTTATTCT
CTTTTACCTTCTTAATCAATGGACATTGCTACTATTGAGATGAAACCCATTAATAACTGA
ACCCTAATAGAACAACAACCACCAGGATTAGTATTTATTAAAATATGACACTAGGGTCATA
TTTTAATAACCTTTCAAATGCACTTTATTATCCACTATAAAACTAATATACTCTCCTTTT
CCTGCCAGTGTGTCCTGGCCCCCAGCACCCAAGCCTCAGCAGATCTATCCACCCTACTCG
GAAAGAAGATGATTGGGGAAGAGGCAGGGCTAGGGAGGTTTTCTTCCCTATGCATTGTAA
TAAACACATGTTTATTTTGCTGATTCTAAAATCCACAGGAGCTTTGTAGTGAATGTGGAA
AATCAAGATAAAAGAAAATTTAAATCACCCAAAGGTGGCCACCAAATGATAACCACTTT
AGACCATGCCTCTTATGATTTTGATATAATCCATTCCAGTCACTTCGTATTACTTTTACA
CAGTTAGGATTACCTTATATTTTTAATTTTGTAGTTTTGACCTCATTAGTTATAAGCTTA
TGTCATAAAATTAACTTTGCTATAAGAATTCTCAGAGCCTCTGGCAGGGCGTGGTGGCTC
ATGCGTGTAATCCCAGCACTTTGGGAGGCCAAGGCGGGGAAATCACTTGAGGTCAGGAGT
TCGAGACCAGCCTGGCCAACATGGTGAAACCCAGTCTCTACTAAAAATACAAAAAATTAA
CCAGCTGTGGTGGTACACGCCTGTAATCCCAGCTACTTGGGAGGCTGAGGCAGGAGAATT
GCTTGAACCTGGGAGGCAGAGGTTGCAGTAAGCCGAGATCGCTCCACTGCATTCCAGCCT
GGGCAACAGAGCGAGACTCCATCTCAAAGAAGGAAAAAGAGAAAAAAAAAAAAAAGGAAT
TCTCAGGGCTGAATTACATTGCATATTATGGATAGACCATAATTTATCCTGATCATTCCC
CTCTTTGGACATTTATAGGTTGTTTTTAAATTTCTTGCTCTTCTAAAACAATTATGACCA
TTTTTAAAATTCTGTGTATCTCTGATTATTTCTTCAGCATAAATTCCTAGAATTACAATA
TTAAAAGCATTGAAGACATATTGTCAAAATACCTTCCAGAAATGCTGTGCTAGGTACCCT
TATTCTGCAGAATATGAAAATGCATGGTTACTGAGATCTCATCATTCTAATTGTTATATA
TTTATTATCTTTTTTAGACTGGTGGGGAAAGTATTATCTCATTGTTTTATATTTATTTAT
TTGATCATTAGTGAGGTTACACACTTTTTCACAGGTTGATGGCCACAAGTATTTCTCCTT
TAAGAGTTTTTTATTTATATCATTTGTCTATTTTTAAGTCTGAGATTGCATTTTTATATA
AGTCCAATTTGTGACATGCATCTTATATTTTTGTAATAACATATTTAACTTATAGACATT
AGTATTTTTCAGAGTCAAACTCCCAATCTTGTTATTTTTGGCTTTTTTTTAATTGTACTT
ATGAACTAAAGGCATTTCTCAATCCCCAAATCAAGTAACTAAATATTCTCCTTTGGTTTT
CCTAATTGTTTTATGGCTTTCTTTTATTTTTCCTCTGGACTCTCATAATTCATCCAAAAT
GTACCTTGATACCAATTAGCCTTCTTAGCATCTGCTGGGAAAGTTGTTCCCTGTTGTTAC
ACAAACTGTATTGCTTCTGCTACTCAGGAGTGTGTGATGTAGCATCCTCTCTGTAATATG
CATCTTGATTGCTATCAATACCTGCAATTTGATGTCAGTCTTTGTGATTTTAGATTTAA
GCTTACATTAGAAATCATCGTTTTGAACAATCCACTATATCCTTTTGTTTTGTCTTGTTT
TACTTTTTATTACAGAAAATCTCAAACATGCATAAGAGTGTACTAGAATTAACCTAAAAT
ACCCATCACCTAGCACAACATTTATTGACTTAAGAATGTGCTTGTTCTAAGCCATATACG
CCCTTACTCAACTCTGCCACCAGATTTTTTTTATGGAGCAAACCACAGACATCACATCA
TTTGATTCATAAATATTTTAGAACACATCTCTTTTTAAACATAACCACAATTCCATTAGT |

TABLE 17-continued

SEQUENCES

| SEQ ID NO: Human Allele | Nucleotide/Amino Acid Sequence |
|---|---|
| | ACACCAAAAAGTTTAATGTGAGTTCTTTAAATTCATCAAATACCGAGTCTATTTTCAAAT
TGGTCTGAGCCTTTAATTTAAAAGAAAAATGTTTATTTATTAATTCTGTGTTTCATTTGC
TTATTTGTTTCTGTTGAAGCTTTTTGTTTGTTTGTTTTCAAATCAGGATTCAAATACATA
AGGTCTTTCCATTTGACAACTTTCTTGTTCTCTGAAATGCCACGATGTTCCAAGTTTAGG
TTGTACCCTTCCTGCCCTAGTTCTGTAATCAGCTATTTCTCTAAAAACTGTTTGTTTCTT
TGTGGGAAACGGTTTCCAAGACCACAGTCTAGAATGCTCATTGTCATTGTTTCTAAGCCT
TTCTAGTGGACAGAGTTGCTTAAAATTCAGGACTACAAGGAAATATATAAGTGGAAATTT
GCATACTGATTACTCAAATTCAGGACTACAAAGTTTTCACTTAACATCTATATCTCCCCC
TTTCCACACTGAGAAACCTTATTCTCAAAGGCAAAGATGATAGAATTTAAAATTTCCACA
ATTACTCATTTTCTTTATCTCACAACACACATACACACACTACAGTCTCAGAATAGTGGT
ATTAATACTACTATGACATATATGATTACTAAAAGACTAATTTCTTCCCAGCATCCCAGA
ACAACTTGATTAATTTTTAGGTTGACTTCTAGGGCTACATATTTTTATCTGTGCTGGTGG
AGTAAAGTCAAACCCCAAACCCTCATCAAAGTAAGCCTGAAGTCACAAATGATCAGGGAA
GACTGGCTTTTTACTCATAGTCTGGATTGAGACAATTTTCTGGTTGTCTTCCATTACCAA
CAGACAGATTCGGGTTTTTTCTTTACCCTTCTGTTGGCCACCTTTGGATAGTCCCATAT
TCTTGCAAAGACATCTGTGCCTCTCCTGTCTTTGCGTAGGCCTTATTTCCCATTACCCCC
TTACATTTACTAAAAACTGAGATTCTAGTTTACAGAGATTAGTAAATGTTCTAAGACCAG
CCATGGCTTTGGGCTAATTTACTAGTCTATCTTTTTGATCTCTCAATTTTCAGACCCCCA
ATTTTTTTCTTACTTTTATGCCAGTTCAGCTTTACATTTTAAAAGAATTCTGTTCTAGTT
TATCTAGCCTTTCTAAATATTTTGCCCCCAAATTTCCAGATATGAGAATCCTAGTTCATT
TTTCTATTCTTTCTTGCTCAGTAGTGAAAATAGTTAGAACTTTTTTTTTTCCCTGAGAGT
GGCTCTGAACAGATTTTATGCAGCTTTGTTAGTAGTGTTATGTGTATTCATTATTTAAGA
GAAATTCAATTGCCCTTTATGAGATGTTTGTCTAAATTTTTGTACTAATTTCTATTTTG
TTGCATCATGGTTTGATTTATGCAAGCTGAAATATATCAAATTTTTGTAAAGATTCTGTG
TATATTTGCGAAGATTTGTAACCTTTCTGTTCTAAAAAGTGAAAAATAACTGATAAAGGT
AACTTTATTTCTCCTGTATACCTTAACTTAAATCTTGTTTCTTTACAGCATTTCGCTATG
GTCCAGTCTCTTAAGCTTACCATTGAAATTTTAAGAATTGTTAATAGAAATGTAATGTAA
CTTTAAAATTGTGTCAAAAAATTCAGAACTAGATTAAAAAAAAAACTGTTAAAGGTAATT
AGCTCTTATCTTCTCCATATACTTAGGTGGCCAAGACATTTTTATGACAGAAGAACAGAA
GAAATACTATAATGCAATGAAAAAATTAGGATCCAAAAAACCTCAAAAACCCATTCCACG
GCCTCTGGTGAGAGCAATTGAATGACTGTAAATATGTAGAACAGTTGAGTTACTGTGAGG
AACTCAAATTTCCGTAATGCCATCCTTCTTTATTCTTAAAATTTGCAGACATTAAGGACT
CAACAGAAGTCAAGACATATTCAAACACTTAGGAAAATTAGATACTCAAACTCAAAAGTA
AGAGCCTGGACAACAACTTAAATTTATTTTTGAGTGAGCCAGGCAATATGTGCTTAAGTA
AATACTTATTGCGACCATGTGAACTTAGTGGTTTGTTTGAACTTAATTTTGACCAGTTTA
TTTTATTTTATTTCAGTAGTTTTTGGGGAACAGGTGGTTTTTGGTTCCATGTGTAAGTTC
TTTAGTGGTGATTTCTGAGAGTTTGGTGCACCTGTCACCCAAGCAGTGTACACTGTACCC
AGTGTGTAGTCTTGTATTCCTCACCCTCTTCCCACCCATCTCCTTGATTCCCTGAAGTCC
ATTATATCATTCTTATGCCTTTATGTCCTCACAGCTTAGGTCCTACTTATAAGTGAGAAC
ATACAATACTTGATTTTCCATTCCTGAGTTACTTCACTTAGAATAATGGTCTCCAACTCC
ATCCAGGTTGCTGCAAAGGCCATTATTTCATTCCTTTTTATGGCTGACTAGTATTCCATG
GTGTAGATATACCACATTTTCTTTATCTGTTCTTTGGTTGGCAGGCATTTAGGTTGGTTT
CACATTTTTGCCGTTGCGAATTGTGCTGCTACAAACATGTGGTATGTGTAAGTGTCTTTT
TCATATAGTAATTTCTTTTCCTTTGGGTAGGTACCTAGTAGTGAGATTGCTGAATCCAAT
AGTAGTTCTACTTTTGGATCTTTAAGGAATTTCCATACTGGTTTTCATAATGGTTATACT
AGTTTATATTCCCACCAACAGTGTAAAAGTGTTCCCTTTTCACCACATCCATGCCAACAT
CTATTATTTTTTGATTTTAAATTATGATAATTCTTGCAGGAGTAAGGTGGCATCCCAT
TGTGGTTTTAATTTGTATTTCCCTGATAATTAGTGATGTTGAGCATTTTTTTCTATGTT
TCTTGGCCATTTGTAAATCTTCTTTTGAGAATTGTCTGATTATGTCTTTTGCCTACTTTT
GGATAGAATTGTTTTTGTCTTGATGATTTGTTTGAGTTCCTTGTAGATCCTGAAAATTAG
TCTTTTGTCAGATGCATAGTTTGTGAATATTTCTCCCACCTGGTGAGTTGTCTCTTTAC
TCTGCTGATTATTTATTTTGCCGTGCAGAAGATTTTTAGTTTAATTAGGTCTCATTTATT
TATTTTTGTTTTTGTTGCATTTGCATTTGGGTTCTTGGTCATGAATTCTTTGCCTAAGCC
AATATCTGGAAGAGTTTTCTTGATGTTATATTCTATAATTTGTATGGTTTCAGGTCTTAG
AGTTAAGTCTGATCCATCTTGAGTTGATTTTGTACCAGGTGAGAGATGAGGATCTGGCT
TCATTCTTCTACATGCAAATTGCCAATTATCCCAACACAATTTGTGGGATAGGGTGTCCT
TTCCCCAGTTTATGTTTGTTTGCTTTGCCAAAGATCAATTGGCTGTAACTATTTGGCTTT
TTTGGGGGGTTCTCTATTCTGTTCCATTGGTCTACATGCCTGTTTTTATACCAGTACCAT
GCTGTTTCAGTAACTATGGCCTTAGTATAGTTTAAAGTCAGGTAATGTGATGCCTCCA
AATTTGTTCTTTTTGCTTAGTCTTGCTTTGGCTATGCAGGCTCTTTTTTGGTTCCATATG
AATTTTAAGATTTTTTTTCTAGTCCTGTGAAGGATGACGGTGGTATTTTGTTGGGAATT
GCACTGAGTCTGTAGATTGCTTTTGACAGTATGGTCATTTTCACAATGTTAATTCTACCT
ATCCATGAGCAGGGGATGTGTATCCATTTGTTTGTGTCATTAATGATTTTTTTCAGCAGT
GTTTTGTAGTTTTCCCTGTAGAGATCTTTCATCTCCTTGGTGGGTATATTTCTAAGTAT
TTTATTTTTTCTGCAGCTGTTTGTAAAATAAATTGAATTCTTGATTTGTTTCTCAGCTTG
GTTGTTGTTGGTGTATAGCAGTGCTACTGTTTTATGTACATTGATTTTGTATCCTGAAAC
TTTACTGAATTTATTTATCAGATCTAGGAGCTTTTGGATGAGTCTTTAGGGTTTTCTAA
GTATACAGTCATAGCCTTGGCAAATAGCAATAGTTTGACTTCCTCTTTTCCAATTTGAAT
ACTCTTTATTTCTTTCTTATCTGATTGCTGCTGGCTAGGACTTCTGAGTGCTATGTTGA
ATAGAAGTGGTGAAAGTGGGCATCCTTATCTTGTCCCAGTTGTCATAGGGAATGCTTTCA
ACCATTACCTGTTCAGTATGATGTTGGCTGTGGGTTTGTCATAAATGGCTTTTACTACCT
TGTGCTATGTTCCTTCTATGCCAGTTTTGCTGAGGGTTTATCATAAAGAGATGCTGAAT
TTTGTCAAATGCTTTTTCTGTGTCTCGTTGAGATGATCATATGATTTTTGTTTTTAATTCT
GTTTATGTGATGTATCACATTTATTGACTTGCGTATGTTAAACCATCCCTGCATTCCTGG |

TABLE 17-continued

SEQUENCES

| SEQ ID NO: Human Allele | Nucleotide/Amino Acid Sequence |
|---|---|
| | TATAAAACCTGCTTGATCATGGTGGATTTTCTTTTTGATATGCTGTTGGATTTAGTTAGC
TAGTATTTTTTGAGTATTTTTGCACCTATAGTCATCAGGAATATTGGTCTGTAGTTTTCT
TTTTTGTTGTGTCCTTTCCTGGTTTTGGTATTAGGGTGATACTGGCTTCATAGAATGATT
TAGAGAGGATTCCCTCTTTCTCTATCTTTTAGTGTTAGTGTAACCACCCTTGCCCCCTGC
CTAGTCAGAGCCAATTTATCAAGATGGGGGAATTGCAATGGAGAAAGAGTAATTCACACA
GAGCTGGCTGTGTGGGAGATGGGAGTTTTATTATTACTCAAATCAGTCTCCCCGAGCATT
CAGGGATCAGAGGTTTTTAAAGATAATTTGGTGGGTAGGGGCTAGGGAAATGGGGAGTGC
TAATTGGTCAGGTTTGATATGGAATCATAGGGGGTCGAAGTGAGGTTTTCTTGCTATCTT
CTGTTCCTGGGTGGAATGGCAGAACTGGTTGAGGCAGATTATGGGTCTGGGTGGTGTCAG
CTGATCCATCCAGTGCAAGGTCTGCAAAATATCTCAAGCACTGATCTTAGGTTTTACAGT
ACTGTACTGATGTTATCCCCAGGAGCAATTTGAGGAGGTTCAGACTCTTGGAGCCCAGGG
GCTGCATGACCCCTAAACCTTAATTTCTAATCTTGTAGCTAATTTGTTAGTCCTGCAAAG
GCAGACTGGTCCCCAGGCAAGAGCAGGGGTCATTTTGGGAAAGATCTATTATCAATTTTG
TTTCAAAGTCAAGCCATGAACTGAATTCCTTCCCAAAGTTAGTTCAGCCTATGCCCAGGA
ATGAACAAGGACAGCTTAAAGGTTAGAAGCAGATGGAGTCCATTAGGTGTGATTTCTTTC
ACTATCATAATTTCCTCAGTTATAATTTTGCAAATGCGGTTCCATAAGTAGGACTGGTAC
CAATTCTTCTTTAAATGTCTGATAGAATTCAGCTGTTAATCCATCTGGTCCTGGACTTTT
TTTTGTTGGTAATTTTTTATTACTGTTTCAATCTTGCTACTTTTTGTTGGTCTGTTCAG
AGTTTCTATTTCTTCCTGATTTAATCTAGGATGGTTGTATATTTCCAGGAATTTATCCGT
TTCCTCTGGATTTTCTAATTTGTGCATGTATGTGTTTGTAGTAGCCTTGAATGATCTTTC
GTATTTCTGTGGTATCAGTTGTACTATCTCCTGTATCATTTTTAATTGAGCTTATTTGA
TCTCTCTTCTTTTCTTGGTTAATCTCACTAATGGTCTATCATTTTTATCTTTCCAAATAA
CCAGCTTTTTGTTTCATTTACCATTTGTATTTTTTTTGTTTCAGTTTAATTTATTTCTGC
TTGATCTTTGTTATTTATTTTCTTCTGCTGGGTTTGGATTTGCCTTTGGCTTGTTTTTCT
TTCTCTAATTCCTTGAGATCTGACCTTAGATTGTCTGTGAGTGCTCTTTCAGACATTATG
ATGTACGCATTTAATGCTACAAACTTTCCTCTTAGCACCACTTTTGCTGTATCTCAGTGG
TTTTCATAAGTTGTGTCACTGTTATCATTCAGTTCAAAGAATTTTTAAATTTCCATCTTG
ATTTCATTGTTAACCCAAAGATCATTCAAGAGGAGATTATTTAATTTCCATGTATTTGTA
TAGTTTTGAAGGTTCCTTTTGGAGTTAATTTCCAGTTTTTTTCCACTGTGGTCTGAGAGG
ATACTTGATATGATTTCGATTTTCTTAAATTTATTATGACTTGTTTTGTGATCTATCATA
TGGTCTATCTCCATGTGATATGGAGAATGCTCCATGTGCTGATGAATAGAATGTATATTC
TGCAGTTGTTGGGTAGAATGTTCTGTAAATATCTGTTAATTTCATTTGTTCTAGGGTATA
GTTTAAGTCCATTGTTTCTTTGTTTAATTTCTGTCTTGATTACCCGTCTAGTGCTGTCAG
TGGAATACTGAAGTCTCCCAGTATTATTGTGTTGCCTCATTACTTAGGTCTAATAGTGAT
TGTTTATGAATTTGGGAGCTCCAGTGTTAGGTACACATATATTTAGGACTGTGATGTTT
TCCTGTTGGACTAATCATTTTATCATTATATAATGTCCCTCTTTGTCTTTTTTAACTTTT
GTTGCTTTAAAGTCTGTTTTGTCTGATGTAAGAATAGCTACTCTTGCTCACTTTTCATTT
CCATTTGCATGGAATGTCTTTTTCCACCCTTTACCTTAAGTTTATATGAGTCCTTATGTG
TTAGGTGAGTCTCTTGAAGACAGTAGATGCTTGGTTTGTATCCATTCTACAATTCTATGT
CTTTTAAATGGAGCGTTTAGGCCATTTACATTCTACGTTAGTATTGAGATGTGAAGTACT
GTTCTATTCATCATGTTAGTTGTTGCCTAAATACTTTGTTGGGTTTTTTAAAATTATGTT
GTTGTTTATAGGCCCCGTGAGAATTATGCTTTAAGGAGGTTTTGTTTGTTTGTTTGTTT
TGTTTTGTTTTGGTGTATTTCAAGGTTTGTTTCATAATTTAGAACTCCTTTTTGCATTTC
TTGCAGTGTTGGTTTGGTGGTGATGAATTCTCTCAGCATTTATTTGTCTGAAAAAGACTT
TATCTCTCCCTCTTTTTATGAAGCTTAGTTTTACTGGATACAAAATTCTTGGCTGACAAT
TATATTGTTTATGGAGGCTAAAGATAGGACCCCAATTCCTTCCAGCTGGTAAGGTTTCTG
CTGAGAAGTTAACTGTTAATCTGATAGGTTTTCCTTTATAGGTTATCTAATTCTTTTGTC
TCACAGCTCTTAAGATTCTTTCCTTCATCTTGACTTTAGATAACTTGATGACTATGTGCC
TAGGTGATAATCTTTTTGTGATGAACTTCCCAGAAGTTCTTCGAGCTTCTTATTTGGTTG
TCTAGATTTCTAACAAGGCCAGGAAAGTTTTCCTCAATTATTTCTTCAGATAAGTTTTAT
GAACTTTAGATTTCTTCATCAGGAAGACCAATTATTCTTAGGTTTAGCCATTTAACATAA
TCCCAAATTTCTTGGAGGCTTCATTCATTTTTTAAACTTTTTTCTTTGTCTTTGTCTGAT
TGGCTTTTAATTCAAAAGCTTTGTCTTTGAGCTCTAAAGTTCTTCTACTTGTCCTAGTCT
ATTGTTGAAACTTACCATGGCACTTTGCATTTCCGTAGGTGTTTCTTTCATTTCCAGAAG
TTGTGAGTATTTTTCTTTATGATATCTATTTCTCTGGAAAATTTTCTTATCCATATCTT
GTATTGTTGTTTAAATTTCTTTAAGTGGGTTTTCACCTTTCTTTGGTATCTCCTTGATTA
GCTTAATAATAAATCTTCTGAATTCTTTATCTGGAAATTCAGAGATTTCTTCTTGGTTTG
GATCCATTGCTGAGAAGCTAGTATGATCTTTTGGAGGTGTTATAGAACCTATTTTGTCAT
ATTACCAGAATTACTTTTCTGGTTCCTTTTCACTTGGGTAGACTATTACTTAAAATTGTT
CTTGGATTTATTTTAATTGAACTGTGTTTTTAAATTTAAAATATTTTCCCTCTTTAAC
ATCAGGACAGTGTGTATTTTAGCCTAATTTGATTATTGGTGCTTGTAGGAGTAAAGACTC
TGTATGAGATCCTTAGTTATAAAGAGTCATTGTGCACTGGCTTTCCCTGATGCTGGTTGT
AGTAGTTACTGTCTTAGTGTGCTGGCAAGTTCACTGTCTCCTATGGAGTTGGAATGGCAG
GGATCTCTTGCAGCTTATCTGGTTCTCTCATGGTGTACATTTTTATTTATTTATTTATTT
ATTTTTTCCCAGTGTTTTATTTACTGACTTGATGATTCAGGCTTCAGGCCAATAGAGAAG
GTATCCCTGAGTAGGCATTGGCTATGGCTAAGGCAGGTGGGTAAATGTAATACCCAACAG
TGGGCTGAGGTCCCAGCCTTGATGAAGGTGGCTGGGAGACCTCTCAGTTAGATGCGCTGA
GGTTTTATCAGGGTGAAGAGTAGAAGCTACCTCAGCTCCTCTGCCAGGTCAGCCAGAAAG
CTATTCACCTCACAGCCTCACTCCTATCCCAGTGTTTTGGCTGTTCAGATCAGACAGCCA
CCTCTTTTCATCTGTAGGAATGTTGATGTTCAAGTAGGGAGGAACTGTGACTCTGCCTC
TCACACAGCCTGAATCTAGGGTGTGCTCCTTCTCTGGGGCCGCACTCACCCTGGATTGTT
CCAGACAGGCTGTCTATAGATGCCTCCATACTGTGTTCCTGTGGGGAAGCCCCAGCTGT
GTCTGCAGTGAAGTGCCAGAGGAAAACAAGGACCTCTTTTCTAAGGCCCTTCACAATCAC
AGAGGATGCCTGCCCATTGGGCTAGAGGTGCAGACTTTCCCTACTGTGCCAGCACTGCAA |

TABLE 17-continued

SEQUENCES

| SEQ ID NO: Human Allele | Nucleotide/Amino Acid Sequence |
|---|---|
| | TTGTGTTTCTGCTGTGAGAAACTACCCACCAGCAGAAAGATCTGGAACTCAAGACCTGCT |
| | CTTCAGATTCTTTTGTCCCACAGGGTGATCCCCTGATGTGGTGCACTCCCCCTTCCCTAG |
| | GGATGGGGCTTCCTGAAAGCCAGACTGCAGTATTGTTATTGCTCTTCTGGTTCTAGCCAC |
| | CTGGCAGGGCTACTAGGCTCTGGGGTGGTGCTGGGGAATGTTTGCAAAGAGTCCTGTGAT |
| | GTGATCTGTTTTCAGGTTTCCCAGCTGTGGATACCAGCACCTGCTCTGGTGGAAGTGGCA |
| | GGAGAGTGAAGTAGACTCTGTGAGAGTCCTTGGCTGTAGATACATTTAGTATGCTGGCTT |
| | TCTCAAATGCTGGTTATGCTAGCAGTGAAGTTGTCACGTGGACAGACTCAGGACCTCTGG |
| | TTAGTCAGGATGTTGCAGGCAGTAGAATTAGCTGTCGTTTTCTCCTTCCTGGGATCAGGG |
| | CTATTCTGTCATGAATTGCAGTCATGTCCTGAGTTGGTTGACCTCCAGCCAGGAGGTGGT |
| | GCTTTCAAGAGAGCACCACTGTGCTATTAGCAGTGGGATATACGCTTGCCCTAAGTTGGC |
| | CAGGGGAGGTATTCTGACTTTCAGGAGACAGGCAGAGCCATAAAACTCCCAAGGGTTTAT |
| | GTCTTTTGTGTTCAGCTACTAGGACAGGTAGAGAAAAACCATCAGGTGAGGGCAGGGTTA |
| | GGCAGGTCCAAGTGCAGACTCTCCTTGAGTGGGGCTTGCCATAACCACTGTGGGGGATGA |
| | GGAAGTGGTCCTCAGGCCAATGAGGTTATGTTCCAGAGGGGATTATGGCTACCTCTGCTG |
| | TGCAGTATAGATCACCAGAGAAGTGGGGGATAGCCAGTAGTGAAAGGCCTCGCCCAGCTC |
| | CCACACAGTTGGTGAGGCTGGTCTTGCTCCTGCAGTACCGTGCTAACTGCACCAAGTTTA |
| | GATCCAGGCAGCCTACTCAGGGATCTCAGACCTGCCCCAGGCCATAAGCTTCCCTGCTGA |
| | CAAAGCAAGCATGGCTTTCAGGCCACATCCCTCCCTGTCTGCCCACAATGTCAGCAGCTC |
| | CTGCACTCGTATCTGCAGCAACTCCCGTTAGCCCCCTGGATTCTGCTCAAGGAAGTTTGT |
| | GCCCAGTCGAAATTATCACAGAATCTAGTTGGAAGTTTCTTTCACCCTATGGCCCCTCCT |
| | TTTATTTGGCTGGCTGCCTTCTCAGAAGACCCCTGTGAGATACAGTCAGGAATGGCATTC |
| | CAGGGCCCAAGCTGGAGACTGGGAGTACCTTCAAGGTTCCTGTTGCTTCTTCTACTTTTG |
| | CACTTCATGCAGCTCCCTAAAGTCATTTCAGCTCTAGGTAAGGTTACAACCTTCTCTCGT |
| | GATCTGCATTTTCAGATTCCCCAGTGGGGATGTGTGTTTGGAGGCAGGTTTTCCCCCCTC |
| | TCACTCACACTTTGGGAACTCACGGCTTTTCACCTGTCTCGTGCAGTCTGCAGTGGCATG |
| | TCACTTCTTTCAAAGGATCTGTGAATTCTTCTGGTTTTCCTGTTACGTTCCTGCGGTGGT |
| | TCTTGAAGCAAAAGTCCACAGTGTGAGTCTCCACACACTGTTCTGTCCATCCAAGTGCGA |
| | GATGCACGTTAGCCCTGCCTCCTATCTCCCATCTTCCTGTTTTTGCTTTTTTCAATTTTG |
| | ATGAGTTTAAAATGTACTTGTAATACTTTTTACCAGTTTTTATTAGTGTGAGGTTAAGGT |
| | CATGCATACTTACTTCCACTTTACAAGTATTTATGATAAACTTTGTATATCAGGGATTGA |
| | CAGACTTTTCCTTAAAGGCCCAGATAGTAAATATTTCAGTCTTTGCTGGCTATATGTCTC |
| | TGTCATAGTACTCAACTCTGCCATTGTGGTACAGAAGCAGCCATAGACAATATAGAACAA |
| | ATAAACATGCCTGTATTCCAACACAACTTTATTTAGGGACATGGAAATTTGGATTTTATA |
| | TAATTATCATATGTCGCAAAACTTTATTCTTCTTTTGATTTTTTTTTTCACCAAACATTT |
| | AAAAATGTAAAACCCATTCTGAGCTCATGGGCTGTACAATAACAGATAGGTCACTGGATT |
| | TGTCCTATAGGCCATGGTTTGCTGATCCCTGTGCTCTATGAATCCTGCTTTATCAGGTAC |
| | TATGGGGCAAGATAGAAGTAGCATCCAGGGCAGCTCTGTGCTTGCAGTCTAATTGAGGAG |
| | CTGAGATGTTGTATACATACTTTAGAGCATTGGGTTATAAAGTAGTACAATAGGCACAAC |
| | AGAGTTGGTAGCTCTGACAAGTGAGTTTGAATGCTCCATAGCAGAGCAGGTCAGTGGAGG |
| | CTGAAAAGTCAGGGAAAGCAGGATGAAAGAAGGGCTTGCAATCGGAAGCATGCAGATAAT |
| | TTGGAGGTTTCCATTTGAACATGAGATCGCAAATGATGAATGCAGTCTACTTACTGCTAT |
| | TCTCGGCACCCAGAATAGGGCCTGGCATAAAATGTGTTCTCAGTAATTATTTATTGAACA |
| | AAAAAATATGTTTTAAGGCACAAACAGAGTCCATCACACTAAAATGAAGTATTTTTGATG |
| | CACTAAAAAAGTCAATGAATGTCAGGGCCAAGGATTTAGAATTTATCTTTTATATAGTGA |
| | GAGATTTTTGACCACAGGGTTAATGATAAAATTATATTTGGGGAGGTTTAATCTGCCAGC |
| | GGTTTATGGGACTTCAGTTTACCTAAATTGAATCTAGCTTTTAAATACCAATCTCACTTT |
| | CTAGTACTAATTTCACTTTAAAATTCTTACTTGAACTTGAGCCAACAACAAGAAAAGAGA |
| | GAATTTTTGTTTACATATGCATGCTATACAACCACTGACTCATTATCAGTTGGTCTTGGG |
| | TTTGGCATTAACTAAAAGAGTCACAAGACACAATATGTTCTGACATATTTATCAGTTTAT |
| | TTCAAGCAACACAGCACACAGCCCAACAAAAGTTGCAACACATAGATGCACTGCACAGAG |
| | CATGCTAGGCTGCAAGAGATGAACTGAAAGTGGGTGCAGACAACATTAACATAGGAAAGC |
| | TGTCACCTCCATTCCTTAGCCATCTTTTATAGCATGCTTATCACATGGCTTATCTGGAAG |
| | TAGGTGCAAAATCACAGCTCTCCCTGTGTAGCTACAACTCACCAATCAAGCCTTCAATGA |
| | ATGATTCTGGTAATCAAATACAATCTCACCACCTAACACTGCACGTTTATCTTGACTTTT |
| | ATATTCCAGATTAGTGTCGCATGAGATAAATCCAACATCATATCACCAGAAGTCCCTGAG |
| | TCTGGGCTTAGACTTTAAATCAACAGTTAGCCATTGACCCACAACTTTATCTCCCCAGAG |
| | ATTTTTTTTCCATCTCTAAAATCCAAATATTAGCTTTTGACCCTCGAAACAAACGAAGAG |
| | CAATTGCATAGGTGGAAAACATAGCTGTTTTAGCCTGAGCATTGATGCATTTCATTTCCA |
| | GTAATAGAACAAGGGGTTTGGAATCACTTCGATTTCTCCTGAAGCATCTTCACAGGGTGG |
| | CTTCATTTCTTGGTTTAAAATTCATACTGAGGTATAGGAGTCACACTGCGTTCTGAAGTG |
| | ACATAGAATGCTTTTTTGATCATCCAACACTTTAGGTAATCCAACACTTTAGGTAATTT |
| | ATGCTCTTAATCTCCTCTATTTGTCTAGATGTTAGAGTTAACATATAAAACCAATACTCAC |
| | CCTCCCTCATATTTCTTTTTGCCCTTCATTCCGCTTCCCTGGAGTGCACCTTTTCTCCAG |
| | CTCCTTTCTGACTTCCCAAATTCATGCTTAAATAGGAAAGGCACTTGACTTTCTAGTGTC |
| | TTCTCCTGGCTCTTTGATAAAAGCCTTGGGGCTCCCAGCACATGGTTCGAAAGTCACAAC |
| | TGAAATGTAGTGTCCTCCAGTGTTGTCCCTACCCTCCTTCCTCTCATTGCCCTTGCTCTC |
| | CCCAAGTGATATATAATTCACTCCCGTGGTTTAATTCATATCAGTATTAATGTCATCTG |
| | TATTCTAGCTTCTGTACCTGCACTCCAAACTCATACTTCTACCTGCCCATTGCCCTTGGA |
| | CCCCCACTGGCACCTCAACTCAACCTGCTCAGGTCAGATCTTATCATCTCTCTTTAATA |
| | TTCCTCATCCTCTGTTCTCTGGCTGGTTAGATGGTTTTATCAACCGGAAACTATATTCTC |
| | AGTCTTAACTTTCTCAAAGCCCACTACATTTGAATTCTCTGACGGTTCTTGCTTCCACCT |
| | CACATTAGCTCTTAAGCCTATATGCTTTTATCTTTATCTGCTGTCACCACCACAAGCCAA |
| | CATCATCTTTGCCTGGATTATATAACAGATCCCTTGGGTGTCTAAAGATGTATTCTTAGG |
| | AGTATGTGAGTTCTCTAAAGATAATAGTGTATGCCACTTTGATTAGGTGATAATATAATA |

TABLE 17-continued

SEQUENCES

| SEQ ID NO: | Human Allele | Nucleotide/Amino Acid Sequence |
|---|---|---|
| | | TAAAACAATATGTACACAGATTGTAAAGCAACCAACGTATAGTCAAGAATGTTATAAAAT
TTCAATGTCTGAATTTGTATTTAGGAATAGTTTTCCACAAAGTGAAGAACAAAGTAGTGC
TTCACAGCAGTTGTATTAAAGAAAATAATGGAATAATTGAGTAATTTCACTGCATATGGT
AGACTTGGCATGCAAACTTGAGTTAGGACCTGTACCTGAACAATCAGCATATACTCACTT
TTTGGGCAGTATGGCCATCTATATATAAACCACATGTAAATTCACCCTCAGTTATAGTAT
AAATTAATCATTTTTTTCTATTTTCAGTTTTAGTAATTATTGGATTATAATCTCATCTAT
TAGCTTTATCTTCAAGTGAACAAGAATTTTAAAATTGGCATTGAAGAATTATTTGAATAC
AGAATTTTGGTTAAGTTCTGATTATTGTGAATTGGCAAATGGAGCATTGAAGATACTAAT
TCCATTTTGTCCAACATACTTATGTGAGCAGGTATTCTCTGCACTAATATTGTTGAAGTA
AGAATACAGAAACAGATAAAATATAGATACCAAGATTCATCTTTTTATTATTAAATCCAA
CATGCACTGTTTTATTTCAGCAAAGCACATCATCAATCACATCAAAGTTATGTTGTTACT
AAGACTTTTTAATATTTTTGTTTTAAAATGGAATTAAAGCTATAAGCCCAAGCACTTAA
AACCAGTTACTAATTACATTTTAATGAAAATATATAAGGCAAGCCTGGGGATTTATAAGA
ATTTCTTGCCCTTTGAAAAGGGTCTGTGTATTTTCAAGGAACTGCTTTAATTGTAAGGA
AAAACAAATTCTGTTGTATTTATGTTCTTTTTATTGTATGTAATTTTATTCTTGCATTCA
AAATGATTTATAATTTCTTTTTTTTCTCAGAACAAATGTCAAGGTCTCGTGTTCGACATA
GTCACAAGCCAGATCTTTGACATCATCATCATAAGTCTCATTATCCTAAACATGATTAGC
ATGATGGCTGAATCATACAACCAACCCAAAGCCATGAAATCCATCCTTGACCATCTCAAC
TGGGTCTTTGTGGTCATCTTTACGTTAGAATGTCTCATCAAAATCTTTGCTTTGAGGCAA
TACTACTTCACCAATGGCTGGAATTTATTTGACTGTGTGGTCGTGCTTCTTTCCATTGTT
AGTAAGTAAAATCAGCAGTCAGAGGGACTTTAAGAACCAGAAGTAAGTTTGTAAATCTTA
TCATTTTTTGAAGTTTGTTCAAACTATCCACAAAGCAGAAAACTGGGCCAAGTGTACTTT
CTGAAAGAATAGACAGGGGTACTAATGCCATTCTCTACTGGGAAGTTGCTAGGAGATAGA
GAGTAATTTCTGTTCCCTTAACTCACTACACAACTGAAATAGAGTTCAATAATCATGCAG
CTAATGTATTCAATGGAAATAGACAAAATTAAAATGACTCAGAAGTTTTTGTGGTGGTAA
CCTGATTTATTCAGATAATTGAGTCAAAGTTCTACCTTTCCTGTGCAACTATAAGCCCTA
TGAGCATTTTTTAGTTTTAAGGATTTACTGCCCATGTTTTTCCTTTGTTCAAAATCCAC
ATGGGTGCCAGATCACAATTATTGTGCCCTGTGGCACTGCTGTGCCCCCTTTCAACCCC
TATACAAGGCCCCATGGCCCACTCTAGATTGGGCTTTCAAGAGTATATCATTCAGACAAT
CAAAGCTTTTTTCTATTCTATATCCCATGTTAACTTAAACCACAGTGTGAACTGTGCTT
GTCTCAGATTCTTTGACCCCGCTTACCAACCAGCCTCATTCTCTAATCAGTATATTTTTC
CTAATCACACGCAGGGTTAACTAAAAGGCTTATAAAAGAATACAAAAGAAAGAAGGTTAT
TACCATACTCCTTCTTATAAAACACACACATACACACATCAACTTTAAAATTAAATTCTT
CATGGCTAAACCATAAGTGCTTACTCTGGGTTTTTGAAGTCTGGTTTTAATTAAACTGTT
AACTTGACATTTTATAATTATGTAAAACTGTCCAGGAGCCCTTCTCATAGTTCAAAACAC
AATGAAGACAAAGAAAACTGATTTTCCAAATGGAAGCTTTTTTGCGATCTCAGAAAGAAT
GCATCAAACAGATATATTGGATCAAGATATTTTGGTTCCTAATGCTACTGCAGCATTGCA
GATGTTTCAGAGAACAACAACAAATATGCTACAGTTCATAGTGTGTTCTGGTTTCTAAGC
CATGATGTTAATGTAGATAAAGCTTATCAATAGATTCTTCCATGAGTTTACAGTTAAGTA
GACCTTTAATTTTTATTAGTCAATTCCAATCACAAGTCTTGGTGAAATTGACAGCAGCAA
AAAAAAAAAAAAAAAAAAAAAAAAGGGCTAGAAAATGGTGGTCAGATGTCTGGGGAGGCC
CTCTAAGAACTCAAAGAGCCCTTCCTCTGATGAGAAAAGAGAAGCTCATTCATTCCAACA
GCTCCTTCCATGCAGTGCCAGGCATCATGCACTTTGCGGAAATGTTTCTGACTTTTGTCC
TTTGAACAACTGCTTGGCAATTGCAGTTATACATGCTGTATGGCATTTGCCCCAGTGGAT
GAGAAAATCTACATATTAAGCCAAATAATACTCAGCGGTAGGATTAATCCATATATTAAT
CCTACTTACTAATGTGGACAGAGTTTTATATGCCTTTGCCAATATTTCTGCCGTCCAACG
CTTTAGCCTCAGTACTTTTCCAAGCTCTTTCCTAAGTTTTTGGAGAAATGCAAAATGAGT
GTGAGTTGAAATGAATCTCTCTAGGAGTTAACAATCTAGTTGAGGTATTACGGCTTAC
TCGTCTTAAAGTGCCAAAAAAAGATAGGGAAATTAATTGAACACCAAATCACATGGTGCA
AAGCAGAAATGAGCTCAGAGAAAGAACAGATTACTATGGGCTTGATCAGCCCAAGAAATA
TTCATAGAGGAGGTAGATCTTAAATGATGGGCCTCCTCCAGTTGTTGCTGAATTGGCACT
TAAGAAACTTTACATCTTTCCAGGGTTGACTTTCCAATTAAAGTATGAATTAAACTTCTT
TGGCACAATTGGGTAGTCAGTGAAGTATATAATCAACTAGTTCTCTTTAGTCATTAGGTG
ACAGCAGAGCATTCTGCTGCCCATGAACCCTAATAGACCCCTAGTGACCTTACAGGACAC
TCAAGGTCATTAGGGGTCATGGGCACTCAAATACTGCCCATGACCCCTAACAACCCTAGA
AGACTCTCAAAGCAAGAACAAGGCCATGTCTACACAAGACAAGCATGTTCCAACCATTCT
ATAATGTTTAGGCCAAAATGTGAATTGTCTTAAATCCTTGTATCACTTGCCTGCAGAGCA
GGCAGGGCGACATTTTAGGTCAAATATTCAGCTGTTTGATCAAACCTCTGAAATGACATT
TATGGGGTTTGCAGCAACAGAGAAGTATCTCCAAATTGTGTCCCTTCAGCTTTTTGAGT
TTGGATCTCAGAAGTCCTTGGAATGAGGATGACAATTATGAAAGATCCATGGGCAGCTTC
AGCCTAAAGGTGAGCATTCCAATGCTACCATTTCCCTCTAGCCCTACAGACATTGTGGCT
CTTTCAGCAGATAAGCTGTCCTCACTTGTAGTAGGGCTGTATTTAAATTCTTCTACACAC
AAATGTAGAAGAACTGTATGGCCCTTGGAAACTATTTTCCAAATTAAGACACAGATAGGT
ATTTTCCCTGATAGTGGTAAAAGAAATTCTTAGTTTTGTACATAAGCTACAAAGTATTGA
TAAAAAGTTGGCCCCCATAGGATTCTGAGGCAGGAGGAGACAGGCTGGATCTGAAACCAGTGT
GCCTTCTGGAAACTTATTTACTTTTCTCCTTCTCCTGAGGTACAATGATTTCTACCTTGG
AAAATCAGGAGCACATTCCTTTCCCTCCGACGCTCTTCAGAATTGTCCGCTTGGCTCGGA
TTGGCCGAATCCTGAGGCTTGTCCGGGCTGCACGAGGAATCAGGACTCTCCTCTTTGCTC
TGATGATGTCGCTTCCTTCTCTGTTCAACATTGGTCTTCTACTCTTTCTGATTATGTTTA
TCTATGCCATTCTGGGTATGAACTGGTTTTCCAAAGTGAATCCAGAGTCTGGAATCGATG
ACATATTCAACTTCAAGACTTTTGCCAGCAGCATGCTCTGTCTCTTCCAGATAAGCACAT
CAGCAGGTTGGGATTCCCTGCTCAGCCCCATGCTGCGATCAAAAGAATCATGTAACTCTT
CCTCAGAAAACTGCCACCTCCCTGGCATAGCCACATCCTACTTTGTCAGTTACATTATCA
TCTCCTTTCTCATTGTTGTCAACATGTACATTGCTGTGATTTTAGAGAACTTCAATACAG |

TABLE 17-continued

SEQUENCES

| SEQ ID NO: | Human Allele | Nucleotide/Amino Acid Sequence |
|---|---|---|
| | | CCACTGAAGAAAGTGAGGACCCTTTGGGTGAAGATGACTTTGACATATTTTATGAAGTGT |
| | | GGGAAAAGTTTGACCCAGAAGCAACACAATTTATCAAATATTCTGCCCTTTCTGACTTTG |
| | | CTGATGCCTTGCCTGAGCCTTTGCGTGTCGCAAAGCCAAATAAATATCAATTTCTAGTAA |
| | | TGGACTTGCCCATGGTGAGTGAAGATCGCCTCCACTGCATGGATATTCTTTTCGCCTTCA |
| | | CCGCTAGGGTACTCGGTGGCTCTGATGGCCTAGATAGTATGAAAGCAATGATGGAAGAGA |
| | | AGTTCATGGAAGCCAATCCTCTCAAGAAGTTGTATGAACCCATAGTCACCACCACCAAGA |
| | | GAAAGGAAGAGGAAAGAGGTGCTGCTATTATTCAAAAGGCCTTTCGAAAGTACATGATGA |
| | | AGGTGACCAAGGGTGACCAAGGTGACCAAAATGACTTGGAAAACGGGCCTCATTCACCAC |
| | | TCCAGACTCTTTGCAATGGAGACTTGTCTAGCTTTGGGGTGGCCAAGGGCAAGGTCCACT |
| | | GTGACTGAGCCCTCACCTCCACGCCTACCTCATAGCTTCACAGCCTTGCCTTCAGCCTCT |
| | | GAGCTCCAGGGGTCAGCAGCTTAGTGTATCAACAGGGAGTGGATTCACCAAATTAGCCAT |
| | | TCCATTTTCTTTTCTGGCTAAAATAAATGATATTTCAATTTCATTTTAAATAATACTTAC |
| | | AGAGATATAAGATAAGGCTACTTGACAACCAGTGGTACTATTATAATAAGGAAGAAGACA |
| | | CCAGGAAGGACTGTAAAAGGACATACCAATTTTAGGATTGAAATAGTTCAGGCCGGGCGC |
| | | AGTGGCTCATGCCTGTAATCCCAGCACTTTGAGAGGCCAAGGCAGGTGGATCACGAGGTC |
| | | AAGAGATCGAGACCATCCTGGCCAACATGATGAAACTCCGTCTCTACTAAAAATACAAAA |
| | | ATTAGCTGGGCATGGTGGCGTGCGCCTGTAGTCCCAGCTACTTGGGAGGCTGAGGCAGGA |
| | | GAATCGCTTAAACCTGGGAGACGGAGGTTGCAGTGAGCCAAGATCGTGCCACTGCACTCC |
| | | AGCCTGGTGACAGAGTGAGACTCTGTTTCAAAAAAGAAAAGAAAAGAAACATGGTTCAAA |
| | | TTATATCTAAACAAAAAAGAATAAGAAACAAAAAACACATTAAAATTTTAAGTTGTATTT |
| | | TCTATGTTTCTAGATACATCATTTTTGTTTGATATTTTCCTGATGCAAGTATGTGGTTTA |
| | | TCACATGTAGCTCTTTTGCATGCTAAATGAAAATTCAAAACTTGCCAATAAATGAATAGC |
| | | TTATTGCAGACATTTTTTACCAACATTAATTATTTTGGGTTTGTTTAAAACCTAGAGGCA |
| | | CAATCTTGACTTGTCAATTACTACCCTTTCACAAGCTACCATCTCAGATATATATATATA |
| | | TATAAATTCAATAAAGCTTTCTGTTTGTGTTCCTTTCAGGTAGTACACTAATATTCCCCT |
| | | TTTGTTCAGTGGTTGTGTGAGTAGTGGTTTAAATGTGGTGCTTTGCTTGCAATTAAAGAC |
| | | TAGAACCAGTGGTGTATCTGACAAGTGTTTAACAACTGACTGTTCAGGAAAAAGAAAGCC |
| | | ATGCTTTATAGCATTCACTAATCTCTGTGGTGTGAGTACTCCCATTATGGCTGATTTCAA |
| | | GCTATCAACATGTTACTGGACGTGGAGTTGAGAAGAGATGCTCATAATAAGTTCTTGAGA |
| | | GCTGGCTCAAGCTGACTGCAGCACATCACTTGCTGAAACTGAAAAGAGAGCCCCACTTGG |
| | | CTGGTTAAGATATTTGCAGTGGGCACCTTGGACAGAGAGTACCCTCTTAGCAACACGT |
| | | GGGGCACGGGGTGAGAGATCCATAGACATACTGCTTAACCAGTGATCTTAGCCATTTGAT |
| | | GAGCCCTATTTACAGTTTTGGCTGAATGTCTGTTTCAAAGAAACACCCAGACCTATCAAA |
| | | AGGGCTTGGGAGCAGGAGGAGCCCAGGAGTTCCCTAAAAACTGGAGATGCCAAGAGGTCA |
| | | AACAGGCATTAGGCTTTCAGTCCCCCAAAAGGCTGGGCGAGGGGCAAAGAACCTACATTG |
| | | TGATCATTGAGGAGTGGAGGAAAACCTCATAGAGATAGCCCTGGAACCCTGTATCTCAGA |
| | | CAGGTGAGAAGAACTGATGTGTCTGTCAGCAGCCTGGAGTCTGAGGTCGGGCCCTCTGAC |
| | | CTGCCCCACACTGCCCAGCAAAGGGAATGGCAGCACTGGATCCTGTGGTGGGCTGAGAGG |
| | | TGATTATTTTCAGTGTGTAAGATCTTACCATGACTTGATGTATTCATTTCAAGGGCCTGA |
| | | GTTTTGTAGGCAGCCTTGTGCTCTGAAGCATTTGGTAAAAATAGTGATAATATCATTATCT |
| | | AATATTTATTTAGTGGTTTCTGTGCATCAGGCACTGGCTAAGCATTTGTCATGAATGATC |
| | | TCTTTTGTACCTCGTACCAACCCAATGAGGAAGATATACCCCATTTAAAAAGGAGAAAAC |
| | | TGAGGCTCAGAGAAGTTGAGTGACCTGCATACAGTCATGCACCTGGTGGAGCCCGAGCCT |
| | | GTGTGCCATGATGGGAAGGGGAAGTGGGTGGGCTCAGGACCAGGGAAGCTTTGAGATGGG |
| | | CTACCAGGGCTCCTGTGCAGGACTGGGAGGGCC |

Example 5

VEGF-A, PDGF-B PATHWAY & ANG-2

VEGF-A is also referred to as VEGF, Vascular Endothelial Growth Factor A, MVCD1, VEGF-A, Vascular Endothelial Growth Factor, Vascular Permeability Factor and VPF. Human VEGF-A binds to the human FLT1/VEGFR1 and KDR/VEGFR2 receptors. Human isoforms, including VEGF-165 and VEGF-145, have been observed.

Vascular endothelial growth factor (VEGF) is a highly specific mitogen for vascular endothelial cells. Five VEGF isoforms are generated as a result of alternative splicing from a single VEGF gene. These isoforms differ in their molecular mass and in biological properties such as their ability to bind to cell-surface heparan-sulfate proteoglycans. The expression of VEGF is potentiated in response to hypoxia, by activated oncogenes, and by a variety of cytokines. VEGF induces endothelial cell proliferation, promotes cell migration, and inhibits apoptosis. In vivo VEGF induces angiogenesis as well as permeabilization of blood vessels, and plays a central role in the regulation of vasculogenesis. Deregulated VEGF expression contributes to the development of solid tumours by promoting tumour angiogenesis and to the etiology of several additional diseases that are characterized by abnormal angiogenesis. Consequently, inhibition of VEGF signalling abrogates the development of a wide variety of tumours. The various VEGF forms bind to two tyrosine-kinase receptors, VEGFR-1 (flt-1) and VEGFR-2 (KDR/flk-1) in humans, which are expressed almost exclusively in endothelial cells. Endothelial cells express in addition the neuropilin-1 and neuropilin-2 coreceptors, which bind selectively to the 165 amino acid form of VEGF (VEGF165).

VEGF is a key regulator of angiogenesis, and its expression in producing cells is regulated by a plethora of external factors. Cytokines, growth factors, and gonadotropins that do not stimulate angiogenesis directly can modulate angiogenesis by modulating VEGF expression in specific cell types, and thus exert an indirect angiogenic or anti-angiogenic effect. Factors that can potentiate VEGF production include fibroblast growth factor 4 (FGF-4), PDGF, tumour necrosis factor α, transforming growth factor β (TGF-β), keratinocyte growth factor (KGF), IGF-I, interleukin 1β (IL-1β), and IL-6.

Angiogenesis has a causal role in many diseases, including neovascular age-related macular degeneration (AMD). Identification of key regulators of angiogenesis, including vascular endothelial growth factor (VEGF), fibroblast growth factor 2, pigment epithelium-derived growth factor, angiopoietins and extracellular matrix molecules, has facilitated the development of novel therapeutic agents that target the underlying pathological angiogenic process. Among these, VEGF serves as a "master switch" for many ocular neovascular conditions through its promotion of endothelial cell proliferation and survival, vascular permeability and ocular inflammation. Anti-VEGF agents are now available, such as aflibercept (EYLEA™), bevacizumab (AVASTIN™, ranibizumab (LUCENTIS™) and pegaptanib sodium (MACUGEN™), an aptamer for neovascular AMD. Unlike bevacizumab, which binds all VEGF isoforms, pegaptanib targets only VEGF165, the isoform responsible for pathological ocular neovascularization.

Flt-1 (VEGFR-1; Unitprot ID: P17948) is one of the two human receptors for vascular endothelial growth factor. The other being KDR (VEGFR-2; Uniprot ID: P35968). The fit-1 protein consists of an external domain containing seven immunoglobulin like domains, a transmembrane region and a cytoplasmic region containing a tyrosine kinase domain. In contrast to other members of the receptor tyrosine kinase family, the kinase domain of fit-1 is in two segments with an intervening sequence of ~70 amino acids. The biology of the VEGF receptors has been reviewed (Neufeld et al., (1999) FASEB Journal. 13:11-22; Zachary (1998) Experimental Nephrology. 6:480-487) and the tyrosine phosphorylation sites have been identified (Ito et al., (1998) J. Biol. Chem. 273:23410-23418).

It is thought that flt-1 may be important in regulating the tissue architecture in developing vasculature while the second VEGF receptor (KDR, VEGFR-2) mediates the mitogenic and angiogenic effects of VEGF in endothelial cells. Evidence to support this theory has come from knockout studies in mice (Fong et al., (1995) Nature. 376:66-70). VEGF and its receptors are over expressed in many tumour types and blocking of VEGF function inhibits angiogenesis and suppresses growth of tumours while over expression of VEGF enhances angiogenesis and tumour growth (Skobe et al., (1997) Nature Medicine 3:1222-1227).

The flt-1 cDNA (EMBL Accession Number X51602, 7680 bp) encodes a mature protein of 1338 amino acids. The structure of the murine flt-1 gene has been determined (Kondo et al., (1998) Gene 208:297-305) and has been used to predict the intron/exon boundaries within the human gene. The promoter region of the human gene has been characterised (Ikeda et al., (1996) Growth Factors. 13:151-162; Morishita et al., (1995) J Biol Chem 270:27948-27953; EMBL Accession Number D64016,1745 bp). The flt-1 gene, which is organised into thirty exons, has been localised to chromosome 13q12 (Rosnet et al. (1993) Oncogene 8:73-179). See EP1130123A2.

Diabetic Retinopathy (DR)

Diabetic retinopathy (DR), a micro-vascular complication of diabetes, is a main cause of blindness in adults. It is well established that DR is determined by both genetic and environmental factors. The longer duration of diabetes, poorer control of blood glucose and elevated blood pressure are the major risk factors in the development of DR. However, genetic factors also play important roles in the pathogenesis of DR. Over the past three decades, the number of people with diabetes mellitus has more than doubled globally, making it one of the most important public health challenges to all nations. DR occurs in 75% of patients with type 2 diabetes mellitus and almost all patients with type 1 diabetes mellitus within 15 years of the manifestation of diabetes. Evidence supports an important role for genetics in determining risk for DR.

VEGF-A has been implicated as a major contributor to the development of DR. VEGF-A could induce the earliest changes in DR including leukostasis, blood-retinal barrier breakdown, and macular edema and neovascularization in progression of DR. The VEGF-A gene is located on human chromosome 6p21.3 and consists of 8 exons. The genetic variants in the VEGF-A gene are suggested to influence levels of VEGF-A protein expression. To date, many studies have investigated the associations between polymorphisms in the VEGF-A gene in humans and DR. −634G/C (+405G/C or rs2010963) polymorphism in the 5-untranslated region and −2578C/A (−2549I/D (in high linkage disequilibrium with −2578C/A) or rs699947) polymorphism in the promoter region of the VEGF-A gene have been investigated.

Age-Related Macular Degeneration (AMD)

Age-related macular degeneration (AMD) is a neurodegenerative disease that leads to visual impairment and accounts for half of all cases of registered blindness in Western individuals older than 65 years of age. There are approximately eight million people in the United States with symptoms of early or intermediate AMD, of whom approximately one million will develop advanced AMD within the next five years. AMD is estimated to affect about 50 million people worldwide, and an increase in aging populations makes AMD a significant public health concern and a major focus of research efforts. AMD is a clinically heterogeneous and genetically complex disease, with multiple environmental and genetic risk factors involved. While epidemiological studies have linked cigarette smoking, alcohol consumption, light exposure, diet, drugs, and high blood pressure to the risk of AMD, familial aggregation and twin studies have suggested that genetic variation may also play an important role in the disease.

Anti-VEGF therapies are now regarded as the standard of care in the treatment of neovascular AMD. Two of the most widely used treatments are ranibizumab and bevacizumab. Ranibizumab (Lucentis®, Genentech, CA, USA), a US FDA-approved anti-VEGF therapy for AMD, is a recombinant, fragmented, monoclonal antibody that binds to VEGF. On the other hand, bevacizumab (Avastin®, Genentech), although not FDA approved for ocular treatment, is a full-length monoclonal antibody reportedly with similar function as that of ranibizumab. Bevacizumab, FDA approved for metastatic colon cancer, has been given as an off-label treatment for ocular angiogenic disorders. An individual's genetic variation may affect the treatment response in both of these drugs.

Polypoidal Choroidal Vasculopathy (PCV)

A subset of wet AMD, termed polypoidal chorio-vasculopathy (PCV), has been identified as a clinical entity. PCV is important, as it may be the main cause of vision loss from AMD in certain Asian and black populations. The distinctive clinical features of PCV include one or more haemorrhagic pigment epithelial detachments (PEDs), extensive exudation, and disease outside of the macula including the periphery. There is a predilection for peripapillary 'polyps'. Patients are also characteristically younger.

There is increasing evidence that Asian patients with neovascular AMD have a variant of AMD, ie, polypoidal choroidal vasculopathy (PCV), which is characterized by polypoidal lesion with inner choroidal vessel abnormality. PCV is more prevalent in Asian subjects, reportedly accounting for about 50% of neovascular AMD compared to 10% in Europeans. Studies have shown that anti-VEGF therapy (ranibizumab) in combination with photodynamic therapy (PDT) was associated with a more favorable outcome compared to ranibizumab monotherapy.

Retinal Angiomatous Proliferation (RAP)

Another variant of AMD in the spectrum of occult CNV is retinal angiomatous proliferation (RAP), which represents about 12%-15% of neovascular AMD. It is associated with proliferation of intraretinal capillaries with retinal anastomosis or CNV.

Diabetic Macular Edema (DME)

Diabetic macular edema (DME), the most common cause of visual loss in subjects with diabetes, is a separate classification assessed independently from the DR spectrum, because it can develop at any stage of DR. The pathogenesis of DR and DME is thought to be related to the loss of pericytes, thickening of basement membrane and endothelial cell loss, leading to microaneurysms, blood-retinal barrier breakdown, increase in inflammation and vascular leakage. There are several treatment modalities for DME. The goal of laser treatment of DME is to reduce disease progression by targeting areas of leakage on the retina. Intravitreal triamcinolone acetonide (IVTA) has also been shown to significantly reduce DME, with maximal action at one week and lasting 3-6 months.

Retinal-Vein Occlusion (RVO)

Retinal-vein occlusion (RVO) is the most common retinal vascular disorder after diabetic retinopathy in the elderly and is often associated with systemic disorders, such as hypertension, hyperlipidemia, diabetes mellitus and/or arteriosclerotic vascular disorders. It is classified as branch retinal vein occlusion (BRVO) or central retinal vein occlusion (CRVO), depending on the site of occlusion and further divided into ischemic (non-perfusion) or non-ischemic (perfusion) RVO, each with differing prognosis and treatment. Macular edema and retinal neovascularization are the two most common causes of visual impairments; thus, ocular managements with laser photocoagulation, intravitreal injections of glucocorticoids or anti-VEGF agents, as well as other surgical or systemic therapies, have focused on these two sequelae.

Retinopathy of Prematurity (ROP)

ROP remains one of the leading causes of childhood blindness. In late stages of ROP, neovascularization of abnormal or pathological vessels arise, due to retinal immaturity, and lead to retinal traction, detachment, hemorrhage and funnel configuration, eventually resulting in poor vision. Neovascularization is mainly driven by VEGF, and currently, the recommended treatment for Type-1 ROP is peripheral ablation by laser.

Angiogenesis & Angiogenesis Inhibitors

Angiogenesis is the formation of new blood vessels. This process involves the migration, growth, and differentiation of endothelial cells, which line the inside wall of blood vessels. The process of angiogenesis is controlled by chemical signals in the body. These signals can stimulate both the repair of damaged blood vessels and the formation of new blood vessels. Other chemical signals, called angiogenesis inhibitors, interfere with blood vessel formation. Normally, the stimulating and inhibiting effects of these chemical signals are balanced so that blood vessels form only when and where they are needed. Neovascularization is the formation of functional microvascular networks with red blood cell perfusion. Neovascularization differs from angiogenesis in that angiogenesis is mainly characterized by the protrusion and outgrowth of capillary buds and sprouts from pre-existing blood vessels.

Angiogenesis plays a critical role in the growth and spread of cancer. A blood supply is necessary for tumours to grow beyond a few millimeters in size. Tumours can cause this blood supply to form by giving off chemical signals that stimulate angiogenesis. Tumours can also stimulate nearby normal cells to produce angiogenesis signalling molecules. The resulting new blood vessels "feed" growing tumours with oxygen and nutrients, allowing the cancer cells to invade nearby tissue, to move throughout the body, and to form new colonies of cancer cells, called metastases. Because tumours cannot grow beyond a certain size or spread without a blood supply, research is focused on trying to find ways to block tumour angiogenesis, with the idea that angiogenesis inhibitors will prevent or slow the growth of cancer. Similarly, ocular diseases and conditions, such as AMD and DR are associated with angiogenesis, and inhibitors are useful for the treatment or prevention of these too.

Thus, anti-VEGF (ie, VEGF-A) ligands and antibodies of the invention are useful for treating, preventing or reducing the risk of one or more of such ocular conditions and cancer (eg, solid tumours).

Angiogenesis requires the binding of signalling molecules, such as vascular endothelial growth factor (VEGF), to receptors on the surface of normal endothelial cells. When VEGF and other endothelial growth factors bind to their receptors on endothelial cells, signals within these cells are initiated that promote the growth and survival of new blood vessels. Angiogenesis inhibitors interfere with various steps in this process. For example, bevacizumab (Avastin®) is an anti-VEGF monoclonal antibody that specifically recognizes and binds to VEGF. Aflibercept (Eylea®) is a VEGF receptor-Fc fusion that binds VEGF. Other angiogenesis inhibitors, including sorafenib and sunitinib, bind to receptors on the surface of endothelial cells or to other proteins in the downstream signalling pathways, blocking their activities.

In addition to, or alternative to, targeting human VEGF-A to address ocular conditions or cancer (or angiogenesis or neovascularisation generally), it may be useful to target the platelet derived growth factor pathway (eg, targeting PDGF-B and/or PDGFR-B), or the angiopoietin-2 pathway. Further details are provided below.

In an example, the invention provides a method of treating or reducing the risk of a VEGF-A-mediated disease or condition in a human in need thereof, the method comprising administering to said human a ligand (eg, an antibody or antibody fragment) that specifically binds a human VEGF-A protein. The invention also provides a corresponding ligand.

In an example, the invention provides a method of treating or reducing the risk of a PDGF-B (ie, platelet derived growth factor-beta)-mediated disease or condition in a human in need thereof, the method comprising administering to said human a ligand (eg, an antibody or antibody fragment) that specifically binds a human PDGF-B protein. The invention also provides a corresponding ligand.

The present invention provides anti-VEGF-A ligands; and VEGF-A-binding or targeting ligands as described herein. The ligands have a variety of utilities. Some of the ligands, for instance, are useful in specific binding assays, for genotyping or phenotyping humans, affinity purification of VEGF-A, in particular human VEGF-A or its ligands and in screening assays to identify other antagonists of VEGF-A activity. Some of the ligands of the invention are useful for inhibiting VEGF-A-mediated activities.

In an example, the invention provides a method of treating or reducing the risk of a PDGFR-B (ie, platelet derived growth factor-beta receptor)-mediated disease or condition in a human in need thereof, the method comprising administering to said human a ligand (eg, an antibody or antibody fragment) that specifically binds a human PDGFR-B protein. The invention also provides a corresponding ligand.

The present invention provides anti-PDGF-B ligands; and PDGF-B-binding or targeting ligands as described herein. The ligands have a variety of utilities. Some of the ligands, for instance, are useful in specific binding assays, for genotyping or phenotyping humans, affinity purification of PDGF-B, in particular human PDGF-B or its ligands and in screening assays to identify other antagonists of PDGF-B activity. Some of the ligands of the invention are useful for inhibiting PDGF-B-mediated activities.

The present invention provides anti-VEGF-A ligands; and VEGF-A-binding or targeting ligands as described herein. The ligands have a variety of utilities. Some of the ligands, for instance, are useful in specific binding assays, for genotyping or phenotyping humans, affinity purification of VEGF-A, in particular human VEGF-A or its ligands and in screening assays to identify other antagonists of VEGF-A activity. Some of the ligands of the invention are useful for inhibiting VEGF-A-mediated activities.

The present invention provides anti-PDGFR-B ligands; and PDGFR-B-binding or targeting ligands as described herein. The ligands have a variety of utilities. Some of the ligands, for instance, are useful in specific binding assays, for genotyping or phenotyping humans, affinity purification of PDGFR-B, in particular human PDGFR-B or its ligands and in screening assays to identify other antagonists of PDGFR-B activity. Some of the ligands of the invention are useful for inhibiting PDGFR-B-mediated activities.

Anti-VEGF-A ligands (eg, antibodies and anti-sense RNA) have been developed based on targeting and neutralising so-called "wild-type" human VEGF-A, which is a commonly-occurring form. While such therapies are useful for human patients harbouring this form of human VEGF-A, the inventor considered it useful to investigate the possibility of targeting rarer—but still naturally-occurring—forms of VEGF-A amongst human populations. In this way, the inventor arrived at insight into the natural occurrences and distributions of rarer human VEGF-A forms that can serve as useful targets (at the protein or nucleic acid level) for human treatment, prophylaxis and diagnosis pertinent to diseases and conditions mediated or associated with VEGF-A activity. This particularly provides for tailored therapies, prophylaxis and diagnosis in humans that are devoid of the common VEGF-A gene or protein.

The skilled person will know that SNPs or other changes that translate into amino acid variation can cause variability in activity and/or conformation of human targets to be addressed. This has spawned great interest in personalized medicine where genotyping and knowledge of protein and nucleotide variability is used to more effectively tailor medicines and diagnosis of patients. The invention, therefore, provides for tailored pharmaceuticals and testing that specifically addresses rarer VEGF-A polymorphic variant forms. Such forms or "alleles" (at the nucleotide level), comprise one or more changes at the nucleotide and amino acid levels from the corresponding common form nucleotide and amino acids sequences, ie, there are one or more non-synonymous (aka "missense") changes at the nucleotide level that translate into one or more corresponding changes in the protein target in humans.

Furthermore, the inventor surprisingly realised that the rarer natural forms, although present in humans at much lower frequencies than the common form, nevertheless are represented in multiple and ethnically-diverse human populations and usually with many human examples per represented ethnic population. Thus, the inventor realised that targeting such rarer forms would provide for effective treatment, prophylaxis or diagnosis across many human ethnic populations, thereby extending the utility of the present invention. In particular, human VEGF-A variations are correlated with increased incidence or risk of VEGF-A mediated diseases or conditions, such as ocular conditions or cancer. Additionally or alternatively, VEGF-A variations are correlated with improved responses following treatments for ocular conditions. The inventor analysed such variations and devised the collections of variants in Tables 18-20. As shown in those tables, the inventor also assessed variation in other human targets that also correlate to incidence or risk of diseases or conditions, such as ocular conditions or cancer, or improved responses following treatments for ocular conditions. In this respect, therefore, the invention provides various aspects and concepts as set out below in this example.

The inventor saw that there is significant industrial and medical application for the invention in terms of guiding the choice of anti-TOI (VEGF-A, PDGF-B and/or PDGFR-B) ligand for administration to human patients for therapy and/or prophylaxis of VEGF-A, PDGF-B and/or PDGFR-B-mediated or associated diseases or conditions. In this way, the patient receives drugs and ligands that are tailored to their needs—as determined by the patient's genetic or phenotypic makeup. Hand-in-hand with this, the invention provides for the genotyping and/or phenotyping of patients in connection with such treatment, thereby allowing a proper match of drug to patient. This increases the chances of medical efficacy, reduces the likelihood of inferior treatment using drugs or ligands that are not matched to the patient (eg, poor efficacy and/or side-effects) and avoids pharmaceutical mis-prescription and waste.

In developing this thinking, in a non-limiting embodiment the present inventor decided to determine a set of human VEGF-A, PDGF-B and PDGFR-B variants on the basis of the following criteria, these being criteria that the inventor realised would provide for useful medical drugs and diagnostics to tailored need in the human population. The inventor selected variants having at least 3 of the 4 following criteria:—

Naturally-occurring human TOI (VEGF-A, PDGF-B or PDGFR-B) variation having a cumulative human allele frequency of 35% or less;

Naturally-occurring human TOI variation having a total human genotype frequency of about 50% or less;

Naturally-occurring human TOI variation found in many different human ethnic populations (using the standard categorisation of the 1000 Genomes Project; see Table 2 below); and Naturally-occurring human TOI variation found in many individuals distributed across such many different ethnic populations.

On the basis of these criteria, the inventor identified variants listed below.

Furthermore, the inventor identified useful variations also in the following human TOIs: complement factor H (CFH), complement component 2 (C2), prothrombin, methylenetetrahydrofolate reductase (MTHFR), Factor V, ARMS2, VEGFR2 and HTRA1. As the titles to Tables 18-20 indicate, the examiner realised that such variants have useful correlations.

In an example, the ligand of the invention comprises an anti-TOI (eg, anti-human VEGF-A) binding site, wherein the binding site is a human or humanized binding site, eg, the binding site comprises or consists of a human or humanized antibody variable domain or plurality of variable domains (eg, human VH/VL binding site(s)). Additionally or alternatively, the ligand comprises one or more human antibody constant regions (eg, a human antibody CH1, CH2, CH3 (or all of these) or Fc). In an example, the ligand is an antibody that comprises human or humanized variable regions and human constant regions (eg, bearing one or more mutations to enhance or dampen Fc function in a human patient).

In an example, the invention provides a method of targeting VEGF-A in a human, the method comprising administering to said human a ligand (eg, an antibody or antibody fragment) that specifically binds a human VEGF-A protein that is encoded by a human VEGF-A nucleotide comprising a VEGF-A SNP as described herein. In an example, the human is suffering from or at risk of a VEGF-A-mediated disease or condition. In an example, the method treats or reduces the risk of a VEGF-A-mediated disease or condition in the human. In an example, the condition comprises angiogenesis or neovascularisation.

In an example, the invention provides a method of targeting PDGF-B in a human, the method comprising administering to said human a ligand (eg, an antibody or antibody fragment) that specifically binds a human PDGF-B protein that is encoded by a human PDGF-B nucleotide comprising a PDGF-B SNP as described herein. In an example, the human is suffering from or at risk of a PDGF-B-mediated disease or condition. In an example, the method treats or reduces the risk of a PDGF-B-mediated disease or condition in the human. In an example, the condition comprises angiogenesis or neovascularisation.

In an example, the invention provides a method of targeting PDGFR-B in a human, the method comprising administering to said human a ligand (eg, an antibody or antibody fragment) that specifically binds a human PDGFR-B protein that is encoded by a human PDGFR-B nucleotide comprising a PDGFR-B SNP as described herein. In an example, the human is suffering from or at risk of a PDGFR-B-mediated disease or condition. In an example, the method treats or reduces the risk of a PDGFR-B-mediated disease or condition in the human. In an example, the condition comprises angiogenesis or neovascularisation.

In an embodiment, (i) the antibody or fragment comprises a VH domain derived from the recombination of a human VH segment, a human D gene segment and a human JH segment, the human VH segment encoding the framework 1 of SEQ ID NO: 40 and wherein said human comprises a VH gene segment encoding the framework 1 of SEQ ID NO: 40, or the human expresses VH domains that comprise the framework 1 of SEQ ID NO: 40; and wherein (ii) said human comprises said nucleotide sequence encoding said VEGF-A, PDGF-B or PDGFR-B.

Additionally or alternatively, in an embodiment, (i) the antibody or fragment comprises a human gamma-4 heavy chain constant region that comprises a Leu at position 189 shown in SEQ ID NO: 73 or an Arg at position 289 shown in SEQ ID NO: 73 and wherein said human comprises an IGHG4*01 human heavy chain constant region gene segment, or the human expresses antibodies comprising human gamma-4 heavy chain constant regions comprising a Leu at position 189 shown in SEQ ID NO: 73 or an Arg at position 289 shown in SEQ ID NO: 73; and wherein (ii) said human comprises said nucleotide sequence encoding said VEGF-A, PDGF-B or PDGFR-B.

In a specific embodiment, the anti-VEGF-A, PDGF-B or PDGFR-B ligand, antibody or fragment of present invention comprises an Fc region, wherein the Fc region comprises at least one non-native amino acid residue selected from the group consisting of 234D, 234E, 234N, 234Q, 234T, 234H, 234Y, 234I, 234V, 234F, 235A, 235D, 235R, 235W, 235P, 235S, 235N, 235Q, 235T, 235H, 235Y, 235I, 235V, 235F, 236E, 239D, 239E, 239N, 239Q, 239F, 239T, 239H, 239Y, 240I, 240A, 240T, 240M, 241W, 241 L, 241Y, 241E, 241 R. 243W, 243L 243Y, 243R, 243Q, 244H, 245A, 247L, 247V, 247G, 251F, 252Y, 254T, 255L, 256E, 256M, 262I, 262A, 262T, 262E, 263I, 263A, 263T, 263M, 264L, 264I, 264W, 264T, 264R, 264F, 264M, 264Y, 264E, 265G, 265N, 265Q, 265Y, 265F, 265V, 265I, 265L, 265H, 265T, 266I, 266A, 266T, 266M, 267Q, 267L, 268E, 269H, 269Y, 269F, 269R, 270E, 280A, 284M, 292P, 292L, 296E, 296Q, 296D, 296N, 296S, 296T, 296L, 296I, 296H, 269G, 297S, 297D, 297E, 298H, 298I, 298T, 298F, 299I, 299L, 299A, 299S, 299V, 299H, 299F, 299E, 305I, 313F, 316D, 325Q, 325L, 325I, 325D, 325E, 325A, 325T, 325V, 325H, 327G, 327W, 327N, 327L, 328S, 328M, 328D, 328E, 328N, 328Q, 328F, 328I, 328V, 328T, 328H, 328A, 329F, 329H, 329Q, 330K, 330G, 330T, 330C, 330L, 330Y, 330V, 330I, 330F, 330R, 330H, 331G, 331A, 331L, 331M, 331F, 331W, 331K, 331Q, 331E, 331S, 331V, 331I, 331C, 331Y, 331H, 331R, 331N, 331D, 331T, 332D, 332S, 332W, 332F, 332E, 332N, 332Q, 332T, 332H, 332Y, 332A, 339T, 370E, 370N, 378D, 392T, 396L, 416G, 419H, 421K, 440Y and 434W as numbered by the EU index as set forth in Kabat. Optionally, the Fc region may comprise additional and/or alternative non-native amino acid residues known to one skilled in the art (see, e.g., U.S. Pat. Nos. 5,624,821; 6,277,375; 6,737,056; PCT Patent Publications WO 01/58957; WO 02/06919; WO 04/016750; WO 04/029207; WO 04/035752 and WO 05/040217).

The ligand, antibody or fragment according to the invention (eg, an anti-VEGF-A ligand, antibody or fragment) is for treating or preventing or reducing the risk of (or treats or prevents or reduces the risk of), for example, any disease or condition disclosed in US2012064621A1 or US7704500B2, the disclosure of which diseases and conditions are incorporated herein by reference for potential inclusion in one or more claims herein. Guidance on obtaining and testing antibodies can also be found in that PCT application. Suitable anti-VEGF-A ligands, antibodies or fragments for use in the invention are disclosed in US2012064621A1 or US7704500B2, the disclosure of which (including sequences thereof) are incorporated herein by reference for potential inclusion in one or more claims herein.

Further encompassed by the invention is the use of the anti-TOI (eg, VEGF-A) ligand, antibody or fragment in the manufacture of a medicament for use to attenuate or inhibit a TOI (eg, VEGF-A)-mediated disease or disorder in a human. VEGF-A-mediated or related disorders which are treated by the ligand, antibody or fragment of the invention include, for example, described below.

Thus, a ligand, antibody or fragment of the invention is useful as a therapeutic agent in the treatment of a condition involving TOI (eg, VEGF-A) expression and/or activity. One embodiment, among others, is a method of treatment comprising administering an effective amount of a ligand, antibody or fragment of the invention to a patient in need thereof, wherein functional consequences of TOI activation are decreased. Another embodiment, among others, is a method of treatment comprising (i) identifying a patient demonstrating TOI expression or activity, and (ii) administering an effective amount of a ligand, antibody or fragment of the invention to the patient, wherein a functional consequence of TOI activation are attenuated. An effective amount according to the invention is an amount that modulates (e.g. decreases) the functional consequences of TOI activation so as to modulate (e.g. decrease or lessen) the severity of at least one symptom of the particular disease or disorder being treated, but not necessarily cure the disease or disorder. Accordingly, one embodiment of the invention is a method of treating or reducing the severity of at least one symptom of any of the disorders referred to herein, comprising administering to a patient in need thereof an effective amount of one or more ligands, antibodies or fragments of the present invention alone or in a combined therapeutic regimen with another appropriate medicament known in the art or described herein such that the severity of at least one symptom of any of the disorders is reduced. Another embodiment of the invention, among others, is a method of antagonizing at least one effect of TOI comprising contacting with or administering an effective amount of one or more ligands, antibodies or fragments of the present invention such that said at least one effect of TOI is antagonized, e.g. the ability to promote or maintain angiogenesis or neovascularisation.

Tailoring Antibodies to Rarer TOI (VEGF-A, PDGF-B or PDGFR-B) Variant Profile

As outlined herein (for example, in the context of PCSK9 in Example 1), the invention includes the possibility to tailor treatment of humans further by selecting antibody-based ligands with variable domains and/or constant domains based on gene segments found in many humans of the ethnic populations where the variant TOI forms are found to meet the selection criteria of the invention. This also applies mutatis mutandis where the TOI is human VEGF-A, PDGF-B or PDGFR-B as in the present example. Thus, all disclosure herein relating to tailoring variable and/or constant domains apply to the present example, relating to VEGF-A, PDGF-B or PDGFR-B and is combinable for use in one or more claims herein.

As described in Example 1, an example is provided for ligands comprising antibody VH domains derived from recombination of human IGHV gene segments comprising selected nucleotides at positions in the HCDR1 or FW3 where there is variability in humans (ie, where SNPs occur in humans).

Further information is provided in Table 4, which shows variation at these positions, as well as the variant distributions across the 1000 Genomes Project database relating to many human populations.

In other embodiments, as explained more fully above, the invention provides for ligands which are tailored to the human recipient's genotype and/or phenotype based on alternative human VH gene segments, or on Vκ, Vλ or constant region gene segments (see further Table 9 for representative variants).

Further examples, therefore are:—
(i) wherein the ligand comprises a VH domain derived from the recombination of a human VH segment (eg, human VH3-23*04), a human D gene segment and a human JH segment, the human VH segment encoding the framework 1 of SEQ ID NO: 40 and wherein said human comprises a VH gene segment encoding the framework 1 of SEQ ID NO: 40, or the human expresses VH domains that comprise the framework 1 of SEQ ID NO: 40.
(ii) wherein the ligand comprises a VH domain derived from the recombination of human VH segment IGHV3-7*01, a human D gene segment and a human JH segment, and wherein said human comprises a IGHV3-7*01 VH gene segment or the human expresses VH domains derived from the recombination of human VH segment IGHV3-7*01, a human D gene segment and a human JH segment.
(iii) wherein the ligand comprises a Vκ domain derived from the recombination of human Vκ segment IGKV1-12*01 and a human Jκ segment, and wherein said human comprises a IGKV1-12*01 Vκ gene segment or the human expresses Vκ domains derived from the recombination of human Vκ segment IGKV1-12*01 and a human Jκ segment.
(iv) wherein the ligand comprises a Vκ domain derived from the recombination of a human Vκ segment and a human Jκ segment, the human Vκ segment encoding (i) a CDR3 comprising a Pro at position 7 shown in SEQ ID NO: 36 and wherein said human comprises a Vκ gene segment encoding a CDR3 comprising a Pro at position 7 shown in SEQ ID NO: 36, or the human expresses Vκ domains that comprise a CDR3 comprising a Pro at position 7 shown in SEQ ID NO: 36; or (ii) a FW3 comprising a Ser at position 15 shown in SEQ ID NO: 38 and wherein said human comprises a Vκ gene segment encoding a FW3 comprising a Ser at position 15 shown in SEQ ID NO: 38 or the human expresses Vκ domains that comprise a FW3 comprising a Ser at position 15 shown in SEQ ID NO: 38.
(v) wherein the ligand comprises a human gamma-1 heavy chain constant region that comprises an Asp at position 204 shown in SEQ ID NO: 4 or a Leu at position 206 shown in SEQ ID NO: 4 and wherein said human comprises (i) an IGHG1*01 human heavy chain constant region gene segment, or the human expresses antibodies comprising human gamma-1 heavy chain constant regions comprising an Asp at position 204 shown in SEQ ID NO: 4 or a Leu at position 206 shown in SEQ ID NO: 4.
(vi) wherein the ligand comprises a human gamma-2 heavy chain constant region that comprises an amino acid selected from the group consisting of a Pro at position 72 shown in SEQ ID NO: 6, an Asn at position 75 shown in SEQ ID NO: 6, a Phe at position 76 shown in SEQ ID NO: 6, a Val at position 161 shown in SEQ ID NO: 6 and an Ala at position 257 shown in SEQ ID NO: 6 and wherein said human comprises (i) an IGHG2*01 human heavy chain constant region gene segment, or the human expresses antibodies comprising human gamma-2 heavy chain constant regions comprising said selected Pro at position 72 shown in SEQ ID NO: 6, Asn at position 75 shown in SEQ ID NO: 6, Phe at position 76 shown in SEQ ID NO: 6, Val at position 161 shown in SEQ ID NO: 6 or Ala at position 257 shown in SEQ ID NO: 6.
(vii) wherein the ligand comprises a human kappa chain constant region that comprises a Val at position 84 shown in SEQ ID NO: 16 or a Cys at position 87 shown in SEQ ID NO: 16 and wherein said human comprises (i) an IGKC1*01 human kappa chain constant region gene segment, or the human expresses antibodies comprising human kappa chain constant regions comprising a Val corresponding to position 84 shown in SEQ ID NO: 16 or a Cys at position 87 shown in SEQ ID NO: 16.
(viii) wherein the ligand comprises a human IGLC1*01 lambda chain constant region and wherein said human comprises (i) a human IGLC1*01 lambda chain constant region gene segment, or the human expresses antibodies comprising human IGLC1*01 lambda chain constant regions.
(ix) wherein the ligand comprises a human gamma-4 heavy chain constant region that comprises a Leu at position 189 shown in SEQ ID NO: 73 or an Arg at position 289 shown in SEQ ID NO: 73 and wherein said human comprises (i) an IGHG4*01 human heavy chain constant region gene segment, or the human expresses antibodies comprising human gamma-4 heavy chain constant regions comprising a Leu at position 189 shown in SEQ ID NO: 73 or an Arg at position 289 shown in SEQ ID NO: 73.
(x) wherein the ligand comprises a human gamma-3 heavy chain constant region encoded by a first human IGHG3 (eg, IGHG3*01) constant region gene segment and wherein said human comprises (i) said first constant region gene segment (eg, an IGHG3*01), or the human expresses antibodies comprising human gamma-3 heavy chain constant regions encoded by said first human IGHG3 (eg, IGHG3*01) constant region gene segment.

(xi) wherein the ligand comprises a human epsilon heavy chain constant region encoded by a first human epsilon heavy chain constant region gene segment and wherein said human comprises (i) said first constant region gene segment, or the human expresses antibodies comprising human epsilon heavy chain constant regions encoded by said first constant region gene segment.

(xii) wherein the ligand comprises a human mu heavy chain constant region encoded by a first human mu heavy chain constant region gene segment and wherein said human comprises (i) said first constant region gene segment, or the human expresses antibodies comprising human mu heavy chain constant regions encoded by said first constant region gene segment.

(xiii) wherein the ligand comprises a human alpha heavy chain constant region encoded by a first human alpha heavy chain constant region gene segment and wherein said human comprises (i) said first constant region gene segment, or the human expresses antibodies comprising human alpha heavy chain constant regions encoded by said first constant region gene segment.

(xiv) wherein the ligand comprises a human delta heavy chain constant region encoded by a first human delta heavy chain constant region gene segment and wherein said human comprises (i) said first constant region gene segment, or the human expresses antibodies comprising human delta heavy chain constant regions encoded by said first constant region gene segment.

(xv) wherein the ligand comprises a human kappa light chain constant region encoded by a first human kappa light chain constant region gene segment and wherein said human comprises (i) said first constant region gene segment, or the human expresses antibodies comprising human kappa light chain constant regions encoded by said first constant region gene segment.

(xvi) wherein the ligand comprises a human lambda light chain constant region encoded by a first human lambda light chain constant region gene segment and wherein said human comprises (i) said first constant region gene segment, or the human expresses antibodies comprising human lambda light chain constant regions encoded by said first constant region gene segment.

It may be advantageous for VEGF-A, PDGF-B or PDGFR-B ligands, for the ligand to comprise a gamma-1 or gamma-2 constant region (eg, as per the embodiments (i) to (xvi) above). For example, the ligand comprises said gamma-1 constant region, eg, an ADCC or CDC enhanced constant region meeting embodiment (v).

Determination of Specific Binding of Ligands of the Invention to VEGF-A, PDGF-B or PDGFR-B Variants The specific binding of ligands of the invention to VEGF-A, PDGF-B or PDGFR-B variants can be performed using the SPR method described in Example 1.

Human Polymorphisms

REFERENCES

1. PLoS One. 2013 Dec. 20; 8(12):e84069. doi: 10.1371/journal.pone.0084069, eCollection 2013, "Association of VEGF gene polymorphisms with diabetic retinopathy: a meta-analysis", Gong JY et al. The authors reported a meta analysis which, in conclusion, reportedly demonstrated that DR is associated with VEGF gene −460T/C polymorphism (rs833061).

2. J Diabetes Res. 2014; 2014:805801. doi: 10.1155/2014/805801, Epub 2014 Apr. 28, "The associations between VEGF gene polymorphisms and diabetic retinopathy susceptibility: a meta-analysis of 11 case-control studies", Han L et al. A total of 11 studies fulfilling the inclusion criteria were included in this meta-analysis. A significant relationship between VEGF+936C/T (rs3025039) polymorphism and DR was reported.

3. BMC Ophthalmol. 2013 Oct. 16; 13:56. doi: 10.1186/1471-2415-13-56, "Two polymorphisms (rs699947, rs2010963) in the VEGF-A gene and diabetic retinopathy: an updated meta-analysis", Lu Y et al. The authors reported meta-analysis confirmed the significant association between rs699947 polymorphism and DR after exclusion of outliers.

4. Gene. 2013 Apr. 15; 518(2):310-5. doi: 10.1016/j.gene.2013.01.018. Epub 2013 Jan. 24. VEGF-634G>C polymorphism and diabetic retinopathy risk: a meta-analysis.

Qiu M et al. The aim of the published study was to investigate whether VEGF-634G>C polymorphism is associated with the risk of DR in type 2 diabetes. A systematic search of electronic databases (PubMed, Embase and Web of Science) and reference lists of relevant articles was carried out until Sep. 15, 2012. The pooled odds ratios (ORs) and their corresponding 95% confidence interval (CI) were calculated by a fixed effect model. A total of 1525 DR cases and 1422 diabetic without retinopathy (DWR) controls in 9 independent studies were included in the meta-analysis. A significant relationship between VEGF-634G>C polymorphism and DR was found in an allelic genetic model (OR: 1.13, 95% CI: 1.01 to 1.25, P=0.03) and a recessive genetic model (OR: 1.26, 95% CI: 1.02 to 1.55, P=0.03). The authors concluded that their research confirmed the association between the VEGF-634G>C polymorphism and DR in subjects with type 2 diabetes.

5. Diabetes. 2002 May; 51(5):1635-9, "A common polymorphism in the 5'-untranslated region of the VEGF gene is associated with diabetic retinopathy in type 2 diabetes", Awata T et al. These authors suggest that the −634G>C polymorphism in the 5'UTR of the VEGF gene is a genetic risk factor for diabetic retinopathy.

6. Molecular Vision 2010; 16:1958-1981<http://www.molvis.org/molvis/v16/a213>, Tong Y et al. In conclusion, according to the authors the described Human Genome Epidemiology (HuGE) systematic review presents strong evidence for an association between the HTRA1 rs11200638 G→A polymorphism, LOC387715/ARMS2rs10490924 G→T polymorphism, and AMD, and suggests that both of these genes play important roles in this disease. Potential gene-gene and gene-environmental interactions and possible mechanisms of AMD are also summarized and discussed.

7. J. Pers. Med. 2013, 3, 40-69; doi:10.3390/jpm3010040, "Personalized Medicine in Ophthalmology: From Pharmacogenetic Biomarkers to Therapeutic and Dosage Optimization", Frank S Ong et al. This review comments that: In the case of intravitreal bevacizumab, CFHY402H genotypes, TC and TT, show more than five-fold increased improvement compared to the CC genotype. The data shows that after treatment with bevacizumab, visual acuity of the patients improved from 20/248 to 20/166 (TT) and from 20/206 to 20/170 (TC), but actually decreased from 20/206 to 20/341 for the CC genotype (p=0.016). In a prospective study with twice the number of patients, the CC genotype was confirmed to have worse outcome as measured by distance and reading visual acuity. In a similar experiment with intravitreal ranibizumab, the TC and TT genotypes for CFH showed improvement with fewer injections compared to the CC genotype. Recurrent analysis showed that patients homozygous for the CFH Y402H risk allele (CC) were 37% more likely to require additional ranibizumab injections (p=0.04). Another study found that individuals homozygous for 69S in ARMS2 had decreased central subfield retinal thickness and no improvement in visual outcomes compared to improved visual acuity in ARMS2 rs10490924 and rs1061170 genotypes following ranibizumab treatment. Taking genetics and environmental factors together, the CFH Y402H homozygous CC genotype with BMI≥30 and smoking reportedly conferred the greatest risk.

8. Expert Rev Ophthalmol. 2013 Apr. 1; 8(2): 127-140. doi: 10.1586/eop.13.3, "Genetic risk, ethnic variations and pharmacogenetic biomarkers in age-related macular degeneration and polypoidal choroidal vasculopathy", Jane Z. Kuo et al. This article comments that: Variants in the complement factor H (CFH) gene confers a 7.4-fold increased likelihood of late AMD. AMD is a common complex disorder with complex inheritance patterns due to various gene and environmental interactions. Yet, despite these challenges, AMD represents an unusual example of the "common disease common variant" theory in which several variants identified on the CFH gene have relatively large effects on disease outcome. Even though the most well-established and consistent association of AMD is observed with complement factor H (CFH) on chromosome 1, recent studies have also shown that other candidate genes in the complement pathway, ARMS2/HTRA1 on chromosome 10q26, LIPC, CETP, and TIMP2 are also susceptible loci associated with AMD. In 2005, three independent research groups identified a common coding variant, Y402H (rs1061170), in the CFH gene on chromosome 1 that was strongly associated with susceptibility of AMD, with reported odds ratio (OR) ranging from 2.5 to 3.3 for all AMD and as high as 7.4 for advanced AMD. The Y402H variant results in a tyrosine-to-histidine substitution. The association of CFH in AMD implicated that the complement cascade plays a critical role in the development of AMD and is now also regarded as a major contributor to susceptibility of AMD. In addition to CFH and the complement pathway, the region at chromosome 10q26 also harbors additional signals to AMD susceptibility, namely the age-related maculopathy susceptibility 2 (ARMS2) and the high-temperature requirement factor H (HTRA1) genes. It is also possible that susceptible variants within ARMS2 modulate the promoter activity of HTRA1, so that both ARMS2/HTRA1 contribute to AMD susceptibility. In one European study, the SNP rs11200638 at the promoter region of HTRA1 confers a 49.3% attributable risk and the risk allele was associated with an elevated mRNA and protein expression and level of HTRA1. The risk allele of the same SNP was highly significant in the Chinese and has 10 times the risk of developing AMD compared to subjects with the wild-type allele. Two VEGF polymorphisms, rs699947 and rs2146323, were significantly associated with PDT treatment response. The allele frequency of rs699947 for AA, AC, and CC were 14%, 39%, and 46% in non-responders versus 40%, 48%, and 12% in responders, respectively (p=0.0008). The allele frequency of rs2146323 for AA, AC, and CC were 4%, 32%, and 64% in non-responders versus 24%, 38%, and 38% in responders, respectively (p=0.0369). Thus, the C allele in both SNPs in VEGF were associated with a higher rate of non-responder to PDT (p=0.0003 for rs699947 and p=0.0036 for rs2146323). In classic choroidal neovascularization (CNV), prothrombin (G20210A) and MTHFR (C677A) were significantly associated with PDT responders. In occult CNV, prothrombin (G20210A) and factor V (G1691A) were significantly associated with PDT responders. Two studies have showed a worse visual improvement in subjects with the homozygous TT risk allele at ARMS2 rs10490924 (A69S) after ranibizumab or bevacizumab injections. Other candidate gene studies found that patients with the risk genotype (CC) at rs1413711 of VEGF has a more significant visual gain after ranibizumab, the G allele at rs699946 of VEGF was significantly associated with a better visual prognosis after either intravitreal bevacizumab or triple therapy (PDT with intravitreal bevacizumab and triamcinolone acetonide). In a study examining the cumulative effect of risk alleles at CFH (Y402H; rs1061170), ARMS2 (A69S; rs10490924), VEGF (rs699947 and rs833069), KDR (rs2071559 and rs7671745), LPR5 (rs3736228), and FZD4 (rs10898563) after ranibizumab treatment, subjects without the high-risk alleles in CFH and ARMS2 have significantly more visual improvement compared to subjects with the high-risk alleles (p=0.009). The mean visual acuity improvement was 10 letters in subjects without the 4-risk alleles, compared to no improvement in subjects with all 4-risk alleles. By adding VEGF into the model, they found that subjects with all 6-risk alleles in CFH, ARMS2, and VEGF demonstrated a mean loss of 10 letters after ranibizumab treatment, whereas the other allele groups all demonstrated improvement (p<0.0001), suggesting a cumulative effect of the risk alleles with a poorer response rate to treatment. A comprehensive meta-analysis found variants at ARMS2/HTRA1 (rs10490924, OR=2.27, p<0.00001; rs11200638, OR=2.72, p<0.00001), CFH (rs1061170, OR=1.72, p<0.00001; rs800292, OR=2.10, p<0.00001) or the complement pathway (C2; rs547154, OR=0.56, p=0.01) were significantly associated with PCV, with higher odds ratio observed at variants in ARMS2/HTRA1. The strong association of ARMS2/HTRA1 to PCV was supported by numerous studies of Asian populations.

9. Survey of Ophthalmology, Volume 59, Issue 1, January-February 2014, Pages 1-18, "Predictors of anti-VEGF treatment response in neovascular age-related macular degeneration", Finger et al. The authors reviewed evidence on predictors of anti-vascular endothelial growth factor (VEGF) treatment response in neovascular age-related macular degeneration. Just under half of the SNPs assessed in the CFH gene and 15% of the SNPs assessed in the VEGF gene were found to be associated with visual outcomes or the number of injections required during follow-up.

10. Ophthalmology. 2013 January; 120(1):115-21. doi: 10.1016/j.ophtha.2012.10.006. Epub 2012 Nov. 11, "Variants in the VEGFA gene and treatment outcome after anti-VEGF treatment for neovascular age-related macular degeneration2, Abedi F et al. The authors concluded that: Pharmacogenetic association with anti-VEGF treatments may influence the visual outcomes in neovascular AMD. In patients with the T allele in tSNP rs3025000, there was a significantly better visual outcome at 6 months and a greater chance of the patients belonging to the responder group with anti-VEGF treatment at 3, 6, and 12 months. The visual acuity (VA) outcomes of patients harbouring the T allele at SNP rs3025000 were comparable with those of the pivotal clinical trials but with fewer injections. 11. Ophthalmology. 2014 April; 121(4):905-10. doi: 10.1016/j.ophtha.2013.10.047. Epub 2013 Dec. 21, "Polymorphisms in vascular endothelial growth factor receptor 2 are associated with better response rates to ranibizumab treatment in age-related macular degeneration", Hermann M M et al. The authors evaluated the association of single nucleotide polymorphisms (SNPs) in VEGF genes and their receptors (VEGFR) with the response rate to ranibizumab in 366 patients with neovascular AMD. Univariate analyses of variance (ANOVAs) revealed a significant effect of SNP rs4576072 in the VEGFR2 gene on VA change after 12 months (F[1,235]=14.05; P=0.02). A stepwise linear regression analysis returned a model (P=0.01) with SNPs rs4576072 and rs6828477 in the VEGFR2 gene as independent predictors for VA change after 12 months, with a mean increase in VA of 0.26 on the logarithm of the minimum angle of resolution (logMAR) scale in patients with 3 contributing minor alleles compared with a loss of 0.03 logMAR in patients with no minor allele.

12. Research and Reports in Neonatology 2011:1 5-11; "VEGF 936C>T is predictive of threshold retinopathy of prematurity in Japanese infants with a 30-week gestational age or less", Yagi M et al. The authors found that VEGF 936C>T polymorphism and duration of oxygen administration were independent risk factors for threshold ROP using a multivariate logistic analysis with adjustment for gestational age and birth weight.

13. Clin Cancer Res 2009; 15(17) Sep. 1, 2009, pp 5297-5302, DOI: 10.1158/1078-0432.CCR-08-2576, "The Role of Vascular Endothelial Growth Factor Genetic Variability in Cancer", Bryan P. Schneider et al. The authors comment that recently, genetic variability in VEGF has been studied as a potential predictive biomarker for bevacizumab. The VEGF-1154 AA and -2578 AA genotypes predicted an improved median overall survival, whereas the VEGF-634 CC and -1498 TT genotypes predicted protection from grade 3-4 hypertension in the pivotal trial, E2100. If validated, these finding could help direct which subgroup of patients should receive bevacizumab.

The inventor identified the following SNPs as SNPs of interest for the present invention.

TABLE 18

POLYMORPHISM RISK FACTORS FOR OCULAR CONDITIONS

| POLYMORPHISM | SNP ID | SNP LOCATION (forward strand) | ASSOCIATED EXAMPLE INDICATION |
|---|---|---|---|
| VEGF-A | | | |
| −2578C > A | rs699947 | 6:43768652 | DR |
| −460T > C | rs833061 | 6:43769749 | DR |
| −634G > C | rs2010963 | 6:43770613 | DR |
| +936C > T | rs3025039 | 6:43784799 | DR ROP |
| A > G | rs699946 | 6:43764932 | DR |
| HTRA1 | | | |
| −625G > A ARMS2 | rs11200638 | 10:122461028 | AMD |
| G > T A69S | rs10490924 | 10:122454932 | AMD PCV |
| COMPLEMENT FACTOR H (CFH) | | | |
| 184G > A V621 | rs800292 | 1:196673103 | AMD PCV |
| COMPLEMENT FACTOR 2 (C2) | | | |
| 62G > T | rs547154 | 6: 31943161 | AMD PCV |

NB: as is known in the art SNP location is expressed as chromosome number:nucleotide position, eg, 6:43768652 is nucleotide number 43768652 on human chromosome 6. ARMS2 is also known as age-related maculopathy susceptibility protein 2, ARMD8 and ARMS2_HUMAN LOC387715.

TABLE 19

POLYMORPHISMS ASSOCIATED WITH IMPROVED OCULAR RESPONSES

| POLYMORPHISM | SNP ID | SNP LOCATION (forward strand) | ASSOCIATED EXAMPLE BENEFIT |
|---|---|---|---|
| VEGF-A | | | |
| −2578C > A | rs699947 | 6:43768652 | AA and AC genotypes associated with improved PDT response |
| −111C > A | rs2146323 | 6:43777358 | AA and AC genotypes associated with improved PDT response |
| −1400T > C | rs1413711 | 6:43772941 | CC genotype shows more significant visual gain after anti-VEGF treatment |
| A > G | rs699946 | 6:43764932 | G significantly associated with better visual prognosis after anti-VEGF treatment |
| 398G > A | rs833068 | 6:43774790 | AA or GG genotype associated with less anti-VEGF treatment injections needed |
| 450T > C | rs833069 | 6:43774842 | AA (TT) or GG (CC) genotype associated with less anti-VEGF treatment injections needed |
| −28C > T | rs3025000 | 6:43778432 | T allele associated with visual acuity improvement with lower anti-VEGF administrations |
| COMPLEMENT FACTOR H (CFH) | | | |
| T > C Y402H | rs 1061170 | 1:196690107 | TC and TT genotypes: Improved visual acuity following anti-VEGF treatment |
| −2362T > C | rs3766404 | 1:196682702 | TT (AA) genotype associated with less anti-VEGF treatment injections needed |
| prothrombin | | | |
| 20210G > A | rs1799963 | 11:46739505 | Associated with improved PDT response |
| Methylenetetrahydrofolate reductase (MTHFR) | | | |
| 677C > A A222V | rs1801133 | 1:11796321 | Associated with improved PDT response |
| FACTOR V | | | |
| 1691G > A R506Q | rs6025 | 1:169549811 | Associated with improved PDT response |
| ARMS2 | | | |
| G > T A69S | rs10490924 | 10:122454932 | GG genotype associated with improved anti-VEGF response |
| VEGFR2 | | | |
| 1026A > G | rs4576072 | 4:55120071 | G allele associated with better visual acuity following anti-VEGF |
| 1263G > A | rs6828477 | 4:55100634 | A allele associated with better visual acuity following anti-VEGF |

TABLE 20

POLYMORPHISMS ASSOCIATED WITH IMPROVED CANCER RESPONSES

| POLY-MORPHISM | SNP ID | SNP LOCATION (forward strand) | ASSOCIATED EXAMPLE BENEFIT |
|---|---|---|---|
| VEGF-A | | | |
| −2578C > A | rs699947 | 6:43768652 | AA genotype associated with improved breast cancer response to anti-VEGF |
| −1154G > A | rs1570360 | 6:43770093 | AA genotype associated with improved breast cancer response to anti-VEGF |

The invention thus provides the following concepts:—

Human VEGF-A SNPs Associated with VEGF-A Mediated Diseases & Conditions

1. A method of treating or reducing the risk of a disease or condition mediated by VEGF-A in a human, the method comprising administering to said human an anti-VEGF-A ligand (eg, an anti-VEGF-A trap, antibody or antibody fragment) that specifically binds to a human VEGF-A that is expressed by a VEGF-A nucleotide sequence comprising a SNP selected from the group consisting of rs699947, rs833061, rs2010963, rs3025039, rs699946, rs2146323, rs1413711, rs833068, rs833069, rs3025000 and rs1570360, wherein said human comprises a VEGF-A nucleotide sequence comprising said selected SNP.

Herein, specific binding can be tested using a sample VEGF-A using a routine method known the skilled person, eg, ELISA or SPR (eg, using a method as described herein). For example, the VEGF-A is provided by a sample from said human or another human, eg, a serum or blood sample.

In an example, the ligand comprises an antibody constant region (eg, an antibody Fc region). Optionally, the ligand comprises a human gamma-1 heavy chain constant region that comprises an amino acid selected from the group consisting of an Asp corresponding to position 204 of SEQ ID NO: 42 and a Leu corresponding to position 206 of SEQ ID NO: 42 and wherein said human comprises an IGHG1*01 human heavy chain constant region gene segment, or the human expresses antibodies comprising human gamma-1 heavy chain constant regions comprising said selected amino acid. Optionally, this constant region is comprised by an Fc region of the ligand.

In an example, the ligand comprises an anti-VEGF-A binding site that specifically binds human VEGF-A. Optionally, the binding site comprises one or more antibody variable domains or one or more human VEGF-A receptor domains. In an example, specific binding with a Kd of 1 mm or less (ie, 1 mM or stronger binding), eg, 1 nM or less; or 100 pM or less; or 10 pM or less. Specific binding can be determined, for example, by assessing binding of the ligand to VEGF-A in a sample from said human or another human comprising said VEGF-A. In an example, the sample comprises serum, blood, feces, tissue, a cell, urine and/or saliva of said human.

Optionally, the VEGF-A is a VEGF-A-165 isoform.

In an example, the ligand is an anti-VEGF-A trap, eg, aflibercept. In an example, the ligand is EYLEA™.

In an example, the ligand is an anti-VEGF-A antibody or antibody fragment, eg, ESBA1008, bevacizumab or ranizumab. In an example, the ligand is AVASTIN™ or LUCENTIS™.

In an example, the ligand is an anti-VEGF ankyrin repeat protein (DARPin), eg, abicipar pegol.

In an example, the ligand is an NCE (so-called New Chemical Entity in the art), eg, sunitinib.

In an example, the condition is selected from the group consisting of angiogenesis, neovascularisation, ocular vascularisation and solid tumour vascularisation.

In an example, the condition is subretinal neovascularisation.

In an example, the disease or condition is an angiogenic disease or condition.

Optionally the disease or condition is an angiogenic ocular condition or angiogenic cancer, eg a solid tumour, a gastrointestinal cancer, colorectal cancer, liver cancer, breast cancer, ovarian cancer, non small cell lung cancer, thyroid cancer, an oral cancer, or an haematological cancer.

Optionally the angiogenic disease or condition is selected from the group consisting of psoriasis, rheumatoid arthritis, a hemangioma, an angiofibroma, diabetic retinopathy, corneal neovacularisation and neovascular glaucoma.

Optionally the disease or condition is or comprises vascular permeability (eg, ocular vascular permeability), edema or inflammation in said human.

For example, the disease or condition is selected from the group consisting of brain edema (eg, edema associated with brain injury, stroke or brain tumour); edema associated with an inflammatory disorder (eg, associated with psoriasis or arthritis, rheumatoid arthritis or asthma); edema associated with burns; ascites or pleural effusion (eg, associated with tumours, inflammation or trauma); chronic airway inflammation; capillary leak syndrome; sepsis; kidney disease (eg, associated with increased leakage of protein); and an eye disorder (eg, age related macular degeneration or diabetic retinopathy).

In an example the method is for reducing or reducing the risk of VEGF-A mediated endothelial cell maintenance or proliferation in an angiogenic disease or condition in said human.

In an example, the angiogenic disease or condition is an angiogenic disease or condition recited above, eg, an angiogenic ocular condition.

In an example the method is for regressing neovascularisation in a VEGF-A mediated disease or condition in said human.

In an example the method is for treating or reducing the risk of neovascularisation in a human, wherein the human has VEGF-A ligand-refractory neovascularisation.

In an example, the human has been diagnosed with said disease or condition before said administration of the ligand.

For example, the human is partially or completely resistant to treatment with an anti-VEGF-A ligand, eg, aflibercept, sunitinib, bevacizumab or ranizumab.

In an example, the ligand is administered by intravenous or subcutaneous administration and/or is comprised in an injectable preparation.

2. The method of concept 1, wherein the condition is an ocular condition, eg, diabetic retinopathy or retinopathy of prematurity.

In an example, the condition is diabetic retinopathy (DR).

In an example, the condition is age-related macular degeneration (AMD), eg, exudative AMD.

In an example, the condition is polypoidal choroidal vasculopathy (PCV).

In an example, the condition is retinal angiomatous proliferation (RAP).

In an example, the condition is diabetic macular edema (DME).

In an example, the condition is retinal-vein occlusion (RVO).

In an example, the condition is retinopathy of prematurity (ROP).

In an alternative, instead of "a method of treating or reducing the risk of a disease or condition mediated by VEGF-A in a human", the invention relates to "a method of improving visual acuity in a human".

3. The method of concept 1 or 2, wherein the SNP is selected from the group consisting of rs699947, rs833061, rs2010963, rs3025039 and rs699946.

In an example, the SNP is rs699947 and optionally the condition is DR.

In an example, the SNP is rs833061 and optionally the condition is DR.

In an example, the SNP is rs2010963 and optionally the condition is DR.

In an example, the SNP is rs3025039 and optionally the condition is DR.

In an example, the SNP is rs699946 and optionally the condition is DR.

4. The method of concept 1 or 2, wherein the SNP is selected from the group consisting of rs699947, rs2146323, rs1413711, rs699946, rs833068, rs833069 and rs3025000.

As shown in Table 19, these SNPs are associated with improved ocular responses following ocular treatment (eg, photodynamic therapy (PDT) or VEGF-A antagonism).

In an example, the SNP is rs699947, eg, homozygous for said SNP.

In an example, the SNP is rs2146323, eg, homozygous for said SNP.

In an example, the SNP is rs1413711, eg, homozygous for said SNP.

In an example, the SNP is rs699946, eg, homozygous for said SNP.

In an example, the SNP is rs833068, eg, homozygous for said SNP.

In an example, the SNP is rs833069, eg, homozygous for said SNP.

In an example, the SNP is rs3025000, eg, homozygous for said SNP.

5. The method of concept 3 or 4, wherein the human is homozygous for said SNP.

In another example, the human is heterozygous for said SNP.

6. The method of any one of concepts 2 to 5, wherein the method further comprises treating the human with photodynamic therapy.

For example, the method further comprises treating the human with PDT simultaneously with, or after, administration of said ligand to the human.

7. The method of concept 1, wherein the disease or condition is a cancer.

8. The method of concept 7, wherein the SNP is rs699947 or rs1570360.

In an example, the SNP is rs699947, eg, homozygous for said SNP.

In an example, the SNP is rs1570360, eg, homozygous for said SNP.

9. The method of any preceding concept, wherein the human comprises (a) a HTRA1 nucleotide sequence comprising SNP rs11200638; (b) an ARMS2 nucleotide sequence comprising SNP rs10490924; (c) a CFH nucleotide sequence comprising SNP rs800292, a T at the position of rs1061170 or an A at the position of rs3766404; (d) a complement component 2 (C2) nucleotide sequence comprising SNP rs547154; (e) a prothrombin nucleotide sequence comprising SNP rs1799963; (f) a MTHFR nucleotide sequence comprising SNP rs1801133; (g) a Factor V nucleotide sequence comprising SNP rs6025; or (h) a VEGFR2 nucleotide sequence comprising SNP rs4576072 or rs6828477.

In an example the human comprises a HTRA1 nucleotide sequence comprising SNP rs11200638, eg, in homozygous form.

In an example the human comprises an ARMS2 nucleotide sequence comprising SNP rs10490924, eg, in homozygous form.

In an example the human comprises a CFH nucleotide sequence comprising SNP rs800292, eg, in homozygous form.

In an example the human comprises a CFH nucleotide sequence comprising SNP rs1061170, eg, in homozygous form.

In an example the human comprises a CFH nucleotide sequence comprising SNP rs3766404, eg, in homozygous form.

In an example the human comprises a complement component 2 (C2) nucleotide sequence comprising SNP rs547154, eg, in homozygous form.

In an example the human comprises a prothrombin nucleotide sequence comprising SNP rs1799963, eg, in homozygous form.

In an example the human comprises a MTHFR nucleotide sequence comprising SNP rs1801133, eg, in homozygous form.

In an example the human comprises a Factor V nucleotide sequence comprising SNP rs6025, eg, in homozygous form.

In an example the human comprises a VEGFR2 nucleotide sequence comprising SNP rs4576072, eg, in homozygous form.

In an example the human comprises a VEGFR2 nucleotide sequence comprising SNP rs6828477, eg, in homozygous form.

10. The method of any one of concepts 2 to 6, wherein the human comprises (a) a HTRA1 nucleotide sequence comprising SNP rs11200638; (b) an ARMS2 nucleotide sequence comprising SNP rs10490924; (c) a CFH nucleotide sequence comprising SNP rs800292; or (d) a complement component 2 (C2) nucleotide sequence comprising SNP rs547154.

These SNPs are risk factors for ocular conditions.

In an example, the ocular condition is DR or ROP and the method is for treating or reducing the risk of DR or ROP.

11. The method of any one of concepts 2 to 6, wherein the human comprises (i) an ARMS2 nucleotide sequence comprising a G at the position of SNP rs10490924; (ii) a CFH nucleotide sequence comprising a T at the position of SNP rs1061170 or rs3766404; (iii) a prothrombin nucleotide sequence comprising SNP rs1799963; (iv) a MTHFR nucleotide sequence comprising SNP rs1801133; (v) a Factor V nucleotide sequence comprising SNP rs6025; or (vi) a VEGFR2 nucleotide sequence comprising SNP rs4576072 or rs6828477.

These SNPs are associated with improved responses following treatment (eg, PDT and/or VEGF-A antagonism) of an ocular disease or condition.

In an example, the ocular condition is DR and the method is for treating or reducing the risk of DR.

SNPs Associated With Improved Responses Following Anti-VEGF-A Treatment Of An Ocular Disease Or Condition 12. A method of treating or reducing the risk of a disease or condition mediated by VEGF-A in a human, the method comprising administering to said human an anti-VEGF-A ligand (eg, an anti-VEGF-A trap, antibody or antibody fragment) that specifically binds to a human VEGF-A, wherein the human comprises (i) an ARMS2 nucleotide sequence comprising a G at the position of SNP rs10490924; (ii) a CFH nucleotide sequence comprising a T at the position of SNP rs1061170 or an T at the position of rs3766404; or (iii) a VEGFR2 nucleotide sequence comprising SNP rs4576072 or rs6828477, wherein the ligand comprises a human gamma-1 heavy chain constant region that comprises an amino acid selected from the group consisting of an Asp corresponding to position 204 of SEQ ID NO: 42 and a Leu corresponding to position 206 of SEQ ID NO: 42 and wherein said human comprises an IGHG1*01 human heavy chain constant region gene segment, or the human expresses antibodies comprising human gamma-1 heavy chain constant regions comprising said selected amino acid.

These SNPs are associated with improved responses following anti-VEGF-A treatment of an ocular disease or condition.

In an example, the ocular condition is DR and the method is for treating or reducing the risk of DR.

In an example the human comprises an ARMS2 nucleotide sequence comprising G at the position of SNP rs10490924, eg, in homozygous form.

In an example the human comprises a CFH nucleotide sequence comprising a T at the position of SNP rs1061170, eg, in homozygous form.

In an example the human comprises a CFH nucleotide sequence comprising a T at the position of SNP rs3766404, eg, in homozygous form.

In an example the human comprises a VEGFR2 nucleotide sequence comprising SNP rs4576072, eg, in homozygous form.

In an example the human comprises a VEGFR2 nucleotide sequence comprising SNP rs6828477, eg, in homozygous form.

13. The method of concept 12, wherein the condition is an ocular condition, eg, diabetic retinopathy or retinopathy of prematurity.

In an example, the condition is diabetic retinopathy (DR).

In an example, the condition is age-related macular degeneration (AMD), eg, exudative AMD.

In an example, the condition is polypoidal choroidal vasculopathy (PCV).

In an example, the condition is retinal angiomatous proliferation (RAP).

In an example, the condition is diabetic macular edema (DME).

In an example, the condition is retinal-vein occlusion (RVO).

In an example, the condition is retinopathy of prematurity (ROP).

In an alternative, instead of "a method of treating or reducing the risk of a disease or condition mediated by VEGF-A in a human", the invention relates to "a method of improving visual acuity in a human".

14. The method of concept 12 or 13, wherein the human further comprises a VEGF-A SNP selected from the group consisting of rs699947, rs833061, rs2010963, rs3025039 and rs699946.

In an example, the SNP is rs699947.
In an example, the SNP is rs833061.
In an example, the SNP is rs2010963.
In an example, the SNP is rs3025039.
In an example, the SNP is rs699946.

15. The method of any one of concepts 12 to 14, wherein the method further comprises treating the human with photodynamic therapy.

For example, the method further comprises treating the human with PDT simultaneously with, or after, administration of said ligand to the human.

16. The method of concept 12, wherein the disease or condition is a cancer.

17. The method of concept 16, wherein the human further comprises VEGF-A SNP rs699947 or rs1570360.

In an example, the SNP is rs699947, eg, homozygous for said SNP.

In an example, the SNP is rs1570360, eg, homozygous for said SNP.

Antagonism of VEGF-A & PDGF-B Pathways

PDGF-B is also known as IBGC5, PDGF-2, PDGF2, SIS, SSV and c-sis. Platelet-derived growth factor receptor beta (PDGFRB) is also known as CD140B, IBGC4, IMF1, JTK12, PDGFR-1 and PDGFR1.

PDGF is a growth factor which may play a role in ocular neovascularization, and has been documented to be a mitogen for pericytes, as well as smooth muscles cells, fibroblasts, and other mesenchymal cell types. Pericytes appear critical for the maintenance of established blood vessels and may be important in the maturation process in ocular conditions, such as choroidal neovascularization. It has been hypothesized that there is a period of VEGF dependency of endothelial cells that overlaps with a period of responsiveness to PDGF withdrawal in newly formed neovascular vessels. Established mature vessels may be associated with resistance to anti-VEGF blockade or rapid recurrence of choroidal neovascularization.

PDGF has been demonstrated to stimulate angiogenesis and pericyte recruitment. Loss of pericytes in retinal vessels is thought to be associated with abnormalities of the vasculature and instability, including the formation of microaneurysms and vascular permeability. Loss of pericytes with PDGF-blockade may be associated with regression of maturing neovascularization. Pericytes produce VEGF-A under selected conditions, possibly thereby protecting endothelial cells when generalized suppression of VEGF-A is present.

Reference is made to Am J Pathol. 2006 June; 168(6): 2036-53; "Inhibition of platelet-derived growth factor B signaling enhances the efficacy of anti-vascular endothelial growth factor therapy in multiple models of ocular neovascularisation"; Jo N et al. Jo et al demonstrated increased suppression of neovascularization in experimental models with specific blockade of both VEGF-A and PDGF-B as compared with blockade with VEGF-A alone. In addition, neovascularization became more resistant to VEGF-A blockade with progression. Suppression of VEGF-A and PDGF-B together caused regression of neovascularization not responsive to anti-VEGF-A alone.

Reference is also made to:—

Angiogenesis. 2014 July; 17(3):553-62. doi: 10.1007/s10456-013-9402-5. Epub 2013 Oct. 24; "Antagonism of PDGF-BB suppresses subretinal neovascularization and"; enhances the effects of blocking VEGF-A2; Dong A et al MAbs. 2010 January-February; 2(1):20-34. Epub 2010 Jan. 2; "A dual-targeting PDGFRbeta/VEGF-A molecule assembled from stable antibody fragments demonstrates anti-angiogenic activity in vitro and in vivo"; Mabry R et al.

A treatment regimen combining inhibition of pericyte and endothelial cell function through the use of concomitant administration of anti-VEGF-A targeting and PDGF-BB pathway targeting is useful for blocking both paracrine and autocrine VEGF signalling in endothelial cells.

Thus, this aspect of the invention provides the following.
18. The method of any preceding concept, wherein the method further comprises antagonising PDGF-B in said human.

In an example of any aspect herein, the method comprises administering REGN2176-3 (Regeneron Pharmaceuticals, Inc) to the human. REGN2176-3 comprises aflibercept.
19. The method of concept 18, wherein the method comprises administering an anti-PDGF-B ligand to the human simultaneously or sequentially with the anti-VEGF-A ligand.

In an example, the anti-VEGF-A and anti-PDGF-B ligands are comprised together by a pharmaceutical formulation that is administered to the human. In an example of any aspect herein, the method comprises administering REGN2176-3 (Regeneron Pharmaceuticals, Inc) to the human.

In an example a bispecific ligand (eg, trap or antibody or antibody fragment) is administered, wherein the ligand comprises a human VEGF-A binding site and a huan PDGF-B binding site.

In an example, the anti-PDGF-B ligand antagonises a human PDGF-B encoded by said PDGF-B nucleotide sequence of (i).

In an example, the anti-PDGF-B ligand comprises or consists of an anti-PDGF-B antibody or fragment, an anti-PDGF-B trap, an anti-PDGF-B aptamer (eg, E10030 or FOVISTA™) or an anti-PDGF-B NCE (so-called New Chemical Entity in the art).

Examples of suitable anti-PDGF-B pathway antibodies and variable regions for incorporation into antibodies for use in the invention are disclosed in WO2014109999A1, the disclosure of which, and specifically including the sequences therein of such antibodies and variable regions, as well as methods of testing and medical diseases and conditions for use (which are suitable for the present invention), are incorporated herein as though explicitly written herein and to provide disclosure of features that can be incorporated into concepts herein.

In an example herein, the anti-PDGF-B ligand specifically binds to human PDGF-B dimer (ie, so-called PDGF-BB).
20. The method of concept 18, wherein the method comprises administering an anti-PDGFR-B ligand to the human simultaneously or sequentially with the anti-VEGF-A ligand.

In an example, the anti-VEGF-A and anti-PDGFR-B ligands are comprised together by a pharmaceutical formulation that is administered to the human. In an example a bispecific ligand (eg, trap or antibody or antibody fragment) is administered, wherein the ligand comprises a human VEGF-A binding site and a human PDGFR-B binding site. Reference is made to Dong et al, which describes a suitable example.

In an example, the PDGFR-B ligand antagonises a human PDGFR-B encoded by said PDGF-B nucleotide sequence of (ii).

In an example herein, the anti-PDGFRB antagonises binding of the receptor to human PDGF-B dimer (ie, so-called PDGF-BB), eg, wherein the PDGF-B is encoded by a nucleotide sequence of (i).

Suitable PDGFRβ-specific inhibitors are disclosed in WO2008130704, for example, the disclosure and sequences of which are incorporated herein by reference.
21. The method of any preceding concept, wherein the human has received a human PDGF-B or PDGFR-B antagonist prior to administering said anti-VEGF-A ligand.

Antagonism of VEGF-A & Angiopoietin-2 Pathways

The angiopoietins are ligands for the endothelial cell receptor Tie2 and are essential for vascular development and angiogenesis. Unlike other family members, angiopoietin-2 (Ang2) is strongly up-regulated by endothelial cells at sites of angiogenesis and vascular remodelling, including tumours. Enhanced anti-tumour effects have been observed in preclinical models with combined blockade of both VEGF and Ang2.

The Ang2 pathway acts to remodel blood vessels and, in particular, is active during both developmental and pathological angiogenesis. But, it is nearly absent from mature, quiescent vasculature. Hence a combination Ang2/VEGF blockade results in decreased survival and maturation of neovessels as well as inhibition of pathological leaks. Ang2 inhibition also blocks vascular remodelling driven by inflammation in model systems in which VEGF inhibition is ineffective, suggesting that combination blockade has potential for a greater therapeutic benefit.

The invention thus further provides:—
22. The method of any one of concepts 1 to 17, comprising antagonising angiopoietin-2 (Ang2) in said human.

In an example, the method comprises administering nesvacumab (Regeneron Pharmaceuticals, Inc) to the human.
23. The method of concept 22, wherein the method comprises administering an anti-Ang2 ligand (eg, nesvacumab) to the human simultaneously or sequentially with the anti-VEGF-A ligand.

In an example, the anti-Ang2 ligand comprises or consists of an anti-Ang2 antibody or fragment, an anti-Ang2 trap, an anti-Ang2 aptamer or an anti-Ang2 NCE (so-called New Chemical Entity in the art).
24. The method of concept 22, wherein an anti-Ang2 receptor (eg, anti-human Tie2) ligand is administered to the human simultaneously or sequentially with the anti-VEGF-A ligand.
25. The method of any one of concepts 1 to 24, wherein the human has received a human Ang2 or Ang2 receptor (eg, Tie2) antagonist prior to administering said anti-VEGF-A ligand.
26. The method of any preceding concept, wherein the anti-VEGF-A ligand (eg, an anti-VEGF-A antibody, antibody fragment or VEGF-A trap) comprises a human gamma-1 heavy chain constant region that comprises an amino acid selected from the group consisting of an Asp corresponding to position 204 of SEQ ID NO: 42 and a Leu corresponding to position 206 of SEQ ID NO: 42; and wherein said human comprises an IGHG1*01 human heavy chain constant region gene segment, or the human expresses antibodies comprising human gamma-1 heavy chain constant regions comprising said selected amino acid.

Optionally, this constant region is comprised by an Fc region of the ligand.

In one embodiment, the ligand of the invention is a VEGF-A trap comprising the polypeptide of SEQ ID NO: 127, eg, comprising or consisting of the polypeptide of SEQ ID NO: 127.
27. The method of any one of concepts 1 to 25, wherein the anti-VEGF-A ligand (eg, an anti-VEGF-A antibody, antibody fragment or VEGF-A trap) comprises a human gamma-2 heavy chain constant region that comprises an amino acid selected from the group consisting of a Pro corresponding to position 72 of SEQ ID NO: 44, an Asn corresponding to position 75 of SEQ ID NO: 44, a Phe corresponding to position 76 of SEQ ID NO: 44, a Val corresponding to position 161 of SEQ ID NO: 44 and an Ala corresponding to position 257 of SEQ ID NO: 44 and wherein said human comprises an IGHG2*01 human heavy chain constant region gene segment, or the human expresses antibodies comprising human gamma-2 heavy chain constant regions comprising said selected amino acid.

Optionally, this constant region is comprised by an Fc region of the ligand.

For example, the ligand is a VEGF-A trap comprising one or more human VEGF-A receptor domain sequences fused to a human gamma-1 or -2 heavy chain constant region, eg, a constant region as defined in concept 26 or 27. In an example, such a trap comprises first and second (eg, comprises only two species of) VEGF-A receptor domain sequences, eg, first and second human Flt1 domain sequences; or first and second human KDR domain sequences; or a Flt domain sequence and a KDR domain sequence. In an example, the trap comprises a dimer of the following polypeptide (N- to C-terminally): a human Flt1 Ig-like C2-type 2 domain sequence and a human KDR Ig-like C2-type 3 domain sequence fused to the human gamma-1 heavy chain constant region of concept 26 or human gamma-2 heavy chain constant region of concept 27. In an example, the constant regions are part of antibody Fc regions.

A suitable human Flt1 Ig-like C2-type 2 domain sequence for use in the present invention is shown in SEQ ID NO: 129. A suitable human KDR Ig-like C2-type 3 domain sequence for use in the present invention is shown in SEQ ID NO: 130.

28. The method of any one of concepts 1 to 27, wherein the anti-VEGF-A ligand is a human anti-VEGF-A antibody, antibody fragment or VEGF-A trap.

29. The method of any preceding concept, comprising, before said administering, selecting a human comprising said VEGF-A, HTRA1, ARMS2, CFH, C2, MTHFR, prothrombin, factor V or VEGFR2 SNP, wherein the human is the human of concept 1 or 12.

30. The method of any one of concepts 1 to 28, wherein the human has been determined to comprise said VEGF-A, HTRA1, ARMS2, CFH, C2, MTHFR, prothrombin, factor V or VEGFR2 SNP.

31. The method of any one of concepts 1 to 28, comprising the step of determining that the human comprises said VEGF-A, HTRA1, ARMS2, CFH, C2, MTHFR, prothrombin, factor V or VEGFR2 SNP, optionally, wherein the determining step is performed before administration of the ligand to the human.

32. The method of concept 31, wherein the step of determining comprises assaying a biological sample from the human for said VEGF-A, HTRA1, ARMS2, CFH, C2, MTHFR, prothrombin, factor V or VEGFR2 SNP.

33. The method of concept 32, wherein the assaying comprises nucleic acid amplification and optionally one or more methods selected from sequencing, next generation sequencing, nucleic acid hybridization, and allele-specific amplification and/or wherein the assaying is performed in a multiplex format.

34. An anti-VEGF-A ligand (eg, an anti-VEGF-A antibody, antibody fragment or VEGF-A trap) for use in a method of any one of concepts 1 to 33.

35. The ligand of concept 34, wherein the anti-VEGF-A ligand is a human anti-VEGF-A antibody, antibody fragment or VEGF-A trap (eg, aflibercept).

36. The ligand of concept 34 or 35, wherein said ligand is administered by intravenous or subcutaneous administration and/or is comprised in an injectable preparation.

C2 SNP rs547154 is indicated in the 1000 Genomes database as having an average cumulative allele frequency of 10% across all human populations; a frequency for the AFR population of 15% and above average also for the following human populations: PUR, IBS, GBR, ASW, LWK, YRI. Thus, when the ancestry of the human belongs to one of these populations, the human may have an elevated risk of an ocular disease or condition or other VEGF-A mediated disease or condition and the invention comprises administering the ligand to such a human. Thus, in an embodiment, the human comprises C2 SNP rs547154 and is of AFR, PUR, IBS, GBR, ASW, LWK or YRI ancestry. For example, the human is of AFR ancestry.

VEGF-A SNP rs1413711 is indicated in the 1000 Genomes database as having an average cumulative allele frequency of 64% across all human populations; a frequency for the AFR and ASN populations of 80% and 71% respectively, and above average also for the following human populations: ASW, LWK, YRI, PUR, CHB, CHS and JPT. Thus, when the ancestry of the human belongs to one of these populations, the human may have an improved treatment of an ocular disease or condition and the invention comprises administering the ligand to such a human. Thus, in an embodiment, the human comprises VEGF-A SNP rs1413711 (eg, in homozygous form) and is of AFR, ASN, ASW, LWK, YRI, PUR, CHB, CHS or JPT ancestry. For example, the human is of AFR ancestry. For example, the human is of ASN ancestry. In an example, the method is for improving visual acuity in said human.

VEGF-A SNP rs699946 is indicated in the 1000 Genomes database as having an average cumulative allele frequency of 26% across all human populations; a frequency for the ASN population of 42%, and above average also for the following human populations: PUR 34%, CHB 45%, CHS 41% and JPT 40%. Thus, when the ancestry of the human belongs to one of these populations, the human may have an improved treatment of an ocular disease or condition and the invention comprises administering the ligand to such a human. Thus, in an embodiment, the human comprises VEGF-A SNP rs699946 (eg, in homozygous form) and is of ASN, ASW, PUR, CHB, CHS or JPT ancestry. For example, the human is of ASN ancestry. In an example, the method is for improving visual acuity in said human.

VEGF-A SNP rs3025000 is indicated in the 1000 Genomes database as having an average cumulative allele frequency of 26% across all human populations; a frequency for the AMR, ASN and EUR populations of 30%, 42% and 27% respectively, and above average also for the following human populations: MXL (29%), PUR (38%), CHB (45%), CHS (41%), JPT (40%), CEU (30%), GBR (27%), IBS (39%) and TSI (31%). Thus, when the ancestry of the human belongs to one of these populations, the human may have an improved treatment of an ocular disease or condition and the invention comprises administering the ligand to such a human. Thus, in an embodiment, the human comprises VEGF-A SNP rs3025000 (eg, in homozygous form) and is of AMR, ASN, EUR, MXL, PUR, CHB, CHS, JPT, CEU, GBR, IBS or TSI ancestry. For example, the human is of AMR ancestry. For example, the human is of ASN ancestry. For example, the human is of EUR ancestry.

Prothrombin SNP rs1799963 is almost exclusively in Caucasians; this SNP is indicated in the 1000 Genomes database as having an above average cumulative allele frequency in the following human populations: AMR, EUR, TSI, GBR and PUR. Thus, when the ancestry of the human belongs to one of these populations, the human may have an improved treatment of an ocular disease or condition and the invention comprises administering the ligand to such a human. Thus, in an embodiment, the human comprises prothrombin SNP rs1799963 (eg, in homozygous form) and is of Caucasian, AMR, EUR, TSI, GBR or PUR ancestry. For example, the human is of Caucasian ancestry. For example, the human is of EUR ancestry. In an example, the condition is CNV.

MTHFR SNP rs1801133 is indicated in the 1000 Genomes database as having an above average cumulative allele frequency in the following human populations: AMR, ASN, EUR, CHB, CLM, IBS, JPT, MXL, PUR and TSI. Thus, when the ancestry of the human belongs to one of these populations, the human may have an improved treatment of an ocular disease or condition and the invention comprises administering the ligand to such a human. Thus, in an embodiment, the human comprises MTHFR SNP rs1801133 (eg, in homozygous form) and is of AMR, ASN, EUR, CHB, CLM, IBS, JPT, MXL, PUR or TSI ancestry. For example, the human is of Caucasian ancestry. For example, the human is of AMR ancestry. For example, the human is of ASN ancestry. For example, the human is of EUR ancestry. For example, the human is of EUR ancestry. In an example, the condition is CNV.

VEGFR2 SNP rs4576072 is indicated in the 1000 Genomes database as having an average cumulative allele frequency of 8% across all human populations; a frequency for the AMR and EUR populations of 10% and 11% respectively, and above average also for the following human populations: PUR (14%), CEU (9%), GBR (13%) and TSI (13%). Thus, when the ancestry of the human belongs to one of these populations, the human may have an improved treatment of an ocular disease or condition and the invention comprises administering the ligand to such a human. Thus, in an embodiment, the human comprises VEGFR2 SNP rs4576072 (eg, in homozygous form) and is of AMR, EUR, PUR, CEU, GBR or TSI ancestry. For example, the human is of AMR ancestry. For example, the human is of EUR ancestry. In an embodiment 3 or 4 VEGFR2 SNPs from rs4576072 and rs6828477 provide for improved treatment. Thus, for example, the human comprises 3 or 4 copies of VEGFR2 SNPs selected from rs4576072 and rs6828477, eg, the human comprise GG (ie, the human comprises VEGFR2 SNP rs4576072 in homozygous form) and AA or AG (ie, the human comprises VEGFR2 SNP rs6828477, eg, in homozygous form); or GA (rs4576072) and AA (rs6828477).

Administering Human VEGF-A Ligands to Humans Comprising PDFG-B Pathway SNP Risk Factors Endothelial cells (ECs) in blood vessels under formation are stabilized by the recruitment of pericytes, both in normal tissues and during angiogenesis in pathologic situations, including cancer. Endothelial cells in small blood vessels and capillaries interact with pericytes, cells of mesenchymal origin that provide important support for blood vessel formation and function. Numerous studies describe the significance of members of the platelet-derived growth factor (PDGF) family for recruitment to and productive association of pericytes with the blood vessel endothelium during embryonal development. Strikingly, mice lacking components of the PDGF-B/PDGFR-13 signaling axis are essentially devoid of pericytes, and as a consequence die from microhemorrhaging because of malformed blood vessels. Reference is made to Blood. 2011 Sep. 8; 118(10): 2906-2917, prepublished online 2011 Jul. 21, doi: 10.1182/blood-2011-01-331694, "Pericytes promote endothelial cell survival through induction of autocrine VEGF-A signaling and Bcl-w expression", Franco M et al. The authors describe that newly formed vascular sprouts recruit pericytes primarily through secretion of platelet derived growth factor beta (PDGF-BB) by endothelial tip cells. Pericytes respond by migrating along the matrix-retained gradient of PDGF-BB, and by a proliferative burst as they reach the tip of the sprout. Reciprocally, pericytes up-regulate expression of cell-bound VEGF-A as they mature and are recruited into newly formed vessels. The authors found that pericytes, in addition to producing VEGF-A that acts in a paracrine fashion, stimulate autocrine expression of VEGF-A by tumour endothelial cells. The authors suggest that a treatment regimen combining inhibition of pericyte and endothelial cell function through the use of concomitant administration of a VEGF-targeting antibody and a PDGF-BB/PDGFRβ-targeting antibody for blocking both paracrine and autocrine VEGF signalling in ECs.

The invention thus provides the following aspects:—

1. A method of treating or reducing the risk of a VEGF-A mediated disease or condition in a human, the method comprising administering an anti-human VEGF-A ligand; an anti-human PDGF-B ligand or an anti-PDGFR-B ligand to a human, wherein the human comprises (i) a PDGF-B nucleotide sequence comprising a SNP selected from the group consisting of rs142404523 (ie, a C corresponding to position −776) and a C at the position of rs1800818 (ie, a C corresponding to position −735); or (ii) a PDGFR-B nucleotide sequence comprising a SNP selected from the group consisting of rs246395 (ie, a G corresponding to position 2601) and rs74943037 (ie, a T corresponding to position 1391).

A suitable example of an anti-VEGF-A ligand, which is an antagonist of human VEGF-A, is aflibercept, sunitinib, ESBA1008, bevacizumab or ranizumab. In an example, the ligand comprises or consists of an anti-VEGF-A antibody or fragment (eg, ESBA1008, bevacizumab or ranizumab), an anti-VEGF-A trap (eg, VEGF-A receptor binding sites fused to antibody Fc regions, eg, aflibercept), an aptamer or an NCE (so-called New Chemical Entity in the art, eg, sunitinib).

In an example of any aspect herein, the method comprises administering REGN2176-3 (Regeneron Pharmaceuticals, Inc) to the human. REGN2176-3 comprises aflibercept and an anti-PDGF-B ligand.

In an embodiment, said selected SNP (eg, rs246395) is associated with VEGF-A secretion from pericytes in said human, for example maintained or increased VEGF-A secretion from pericytes in said human (eg, ocular pericytes or pericytes at the site of a solid tumour in said patient). Thus, administration of an anti-VEGF-A ligand would be beneficial to also target such secreted VEGF-A. This is useful, for example, when the disease or condition is angiogenesis or neovascularisation or associated with one or both of these.

For PDGF-B, a C at the position of rs1800818 (ie, −735C) is indicated in the 1000 Genomes database as having an average cumulative allele frequency of 37% across all human populations; a frequency for the AFR and EUR populations of 62% and 41% respectively (ie, above average) and also above average for the following human populations: ASW 60%, LWK 58%, YRI 68%, CEU 46%, FIN 46%, IBS 50% and TSI 38%. Thus, when the ancestry of the human belongs to one of these populations, the human may have an elevated risk of angiogenesis or other VEGF-A mediated disease or condition and the invention comprises administering the ligand such a human. Thus, in an embodiment, the human comprises a PDGF-B nucleotide sequence comprising −735C, ie, a C at the position of PDGF-B SNP rs1800818 and wherein the human is of AFR, EUR, ASW, LWK, YRI, CEU, FIN, IBS or TSI ancestry. For example, the human is of AFR ancestry. For example, the human is of EUR ancestry.

For PDGF-B, SNP rs142404523 (−776T>C) is indicated in the 1000 Genomes database as having an average cumulative allele frequency of 8% across all human populations; a frequency for the AFR and EUR populations of 17% and 10% respectively (ie, above average) and also above average for the following human populations: ASW 16%, LWK 18%, YRI 16%, PUR 11%, CEU 11%, FIN 9%, GBR 12% and IBS 18%. Thus, when the ancestry of the human belongs to one of these populations, the human may have an elevated risk of angiogenesis or other VEGF-A mediated disease or condition and the invention comprises administering the ligand such a human. Thus, in an embodiment, the human comprises PDGF-B SNP rs142404523 and is of AFR, EUR, ASW, LWK, YRI, PUR, CEU, FIN, GBR or IBS ancestry. For example, the human is of AFR ancestry. For example, the human is of EUR ancestry.

For PDGFR-B, SNP rs246395 (2601A>G) the 1000 Genomes database indicates an average cumulative allele frequency of 23% for G across all human populations; a frequency for the AMR and EUR populations of 29% and 30% respectively (ie, above average) and also above average for the following human populations: CLM (36%), MXL (25%), PUR (26%), CEU (39%), GBR (30%), IBS (29%) and TSI (31%). Thus, when the human belongs to one of these populations, it may have an elevated risk of angiogenesis or other VEGF-A mediated disease or condition and the invention comprises administering the ligand such a human. Thus, in an embodiment, the human comprises PDGFR-B SNP rs246395 and is of AMR, EUR, CLM, MXL, PUR, CEU, GBR, IBS or TSI ancestry. For example, the human is of AMR ancestry. For example, the human is of EUR ancestry.

For PDGFR-B, SNP rs74943037 is indicated in the 1000 Genomes database as having an average cumulative allele frequency of 3% for G across all human populations; a frequency for the AFR population of 10% (ie, above average) and also above average for the following human populations: ASW 8%, LWK 14% and YRI 8%. Thus, when the ancestry of the human belongs to one of these populations, the human may have an elevated risk of angiogenesis or other VEGF-A mediated disease or condition and the invention comprises administering the ligand such a human. Thus, in an embodiment, the human comprises PDGFR-B SNP rs74943037 and is of AFR, ASW, LWK or YRI ancestry. For example, the human is of AFR ancestry.

2. The method of aspect 1, wherein the human is homozygous for said selected SNP (eg, homozygous for rs246395 or homozygous for a C at the position of rs1800818 (ie, homozygous for a C corresponding to position −735)).

Such homozygotes may have increased severity or risk of said disease or condition.

3. The method of aspect 1 or 2, wherein the human comprises a PDGF-B nucleotide sequence comprising a SNP of (i) and a PDFGR-B nucleotide sequence comprising a SNP of (ii).

For example, the human comprises a C at the position of rs1800818 and rs246395. In another example, the human comprises a C at the position of rs1800818 and rs74943037.

For example, the human comprises rs142404523 and rs246395. In another example, the human comprises rs142404523 and rs74943037.

4. The method of any one of aspects 1 to 3, wherein the human comprises (a) a VEGF-A nucleotide sequence comprising a SNP selected from the group consisting of rs699947, rs833061, rs2010963, rs3025039, rs699946, rs2146323, rs1413711, rs833068, rs833069, rs3025000 and rs1570360; (b) a HTRA1 nucleotide sequence comprising SNP rs11200638; (c) an ARMS2 nucleotide sequence comprising SNP rs10490924; (d) a Complement Factor H (CFH) nucleotide sequence comprising SNP rs800292, rs1061170 or rs3766404; (e) a Complement Component 2 (C2) nucleotide sequence comprising SNP rs547154; (f) a prothrombin nucleotide sequence comprising SNP rs1799963; (g) a MTHFR nucleotide sequence comprising SNP rs1801133; (h) a Factor V nucleotide sequence comprising SNP rs6025; or (i') a VEGFR2 nucleotide sequence comprising SNP rs4576072 or rs6828477.

In an example, the human comprises a SNP of (a).

For example, the human comprises rs699947 and optionally the condition is DR or a solid tumour.

For example, the human comprises rs833061 and optionally the condition is DR or a solid tumour.

For example, the human comprises rs2010963 and optionally the condition is DR or a solid tumour.

For example, the human comprises rs3025039 and optionally the condition is DR or a solid tumour.

For example, the human comprises rs699946 and optionally the condition is DR or a solid tumour.

For example, the human comprises rs2146323.

For example, the human comprises rs1413711, optionally the human is homozygous for said SNP.

For example, the human comprises rs833068, optionally the human is homozygous for said SNP.

For example, the human comprises rs833069, optionally the human is homozygous for said SNP.

For example, the human comprises rs3025000.

For example, the human comprises rs1570360.

In an example, the human comprises a SNP of (a) and (b). In an example, the human comprises a SNP of (a) and (c). In an example, the human comprises a SNP of (a) and (d). In an example, the human comprises a SNP of (a) and (e). In an example, the human comprises a SNP of (a) and (f). In an example, the human comprises a SNP of (a) and (g). In an example, the human comprises a SNP of (a) and (h). In an example, the human comprises a SNP of (a) and (i').

Optionally in any aspect herein, the ligand specifically binds to or antagonises a VEGF-A, eg, a VEGF-A encoded by a VEGF-A nucleotide sequence comprising a SNP of (a). In one example, this can be determined by specific binding to or antagonism of VEGF-A in a sample in vitro (eg, serum or blood sample) from the human, wherein the human comprises said VEGF-A nucleotide sequence. Specific binding can be determined, for example, by SPR or ELISA as will be known to the skilled person. The skilled person will also be familiar with standard assays for VEGF-A antagonism. Additionally, in an example the genome of the human comprises said SNP of (a).

5. The method of any one of aspects 1 or 4, wherein the human comprises a human VEGF-A nucleotide sequence comprising a SNP selected from the group consisting of rs699947, rs833061, rs2010963, rs3025039, rs699946, rs2146323, rs1413711, rs833068, rs833069, rs3025000 and rs1570360 and the ligand antagonises a VEGF-A encoded by said nucleotide sequence.

In an example of any aspect herein, the VEGF-A is VEGF-A-(165) isoform.

6. The method of any one of aspects 1 to 5, wherein the method further comprises antagonising PDGF-B in said human.

In an example of any aspect herein, the method comprises administering REGN2176-3 (Regeneron Pharmaceuticals, Inc) to the human. REGN2176-3 comprises aflibercept.

7. The method of aspect 6, wherein the method comprises administering an anti-PDGF-B ligand to the human simultaneously or sequentially with the anti-VEGF-A ligand.

In an example, the anti-VEGF-A and anti-PDGF-B ligands are comprised together by a pharmaceutical formulation that is administered to the human. In an example of any aspect herein, the method comprises administering REGN2176-3 (Regeneron Pharmaceuticals, Inc) to the human.

In an example, the anti-PDGF-B ligand antagonises a human PDGF-B encoded by said PDGF-B nucleotide sequence of (i).

In an example, the anti-PDGF-B ligand comprises or consists of an anti-PDGF-B antibody or fragment, an anti-PDGF-B trap, an anti-PDGF-B aptamer (eg, E10030 (FOVISTA™), described in, e.g., U.S. Pat. Nos. 6,207,816; 5,731,144; 5,731,424; and 6,124,449; each of which is incorporated by reference herein in its entirety) or an anti-PDGF-B NCE (so-called New Chemical Entity in the art).

Examples of suitable anti-PDGF-B pathway antibodies and variable regions for incorporation into antibodies for use in the invention are disclosed in WO2014109999A1, the disclosure of which, and specifically including the sequences therein of such antibodies and variable regions, as well as methods of testing and medical diseases and conditions for use (which are suitable for the present invention), are incorporated herein as though explicitly written herein and to provide disclosure of features that can be incorporated into aspects herein.

In an example herein, the anti-PDGF-B ligand specifically binds to human PDGF-B dimer (ie, so-called PDGF-BB).

8. The method of aspect 6, wherein the method comprises administering an anti-PDGFR-B ligand to the human simultaneously or sequentially with the anti-VEGF-A ligand.

In an example, the anti-VEGF-A and anti-PDGFR-B ligands are comprised together by a pharmaceutical formulation that is administered to the human.

In an example, the PDGFR-B ligand antagonises a human PDGFR-B encoded by said PDGF-B nucleotide sequence of (ii).

In an example herein, the anti-PDGFRB antagonises binding of the receptor to human PDGF-B dimer (ie, so-called PDGF-BB), eg, wherein the PDGF-B is encoded by a nucleotide sequence of (i).

Suitable PDGFRβ-specific inhibitors are disclosed in WO2008130704, for example, the disclosure and sequences of which are incorporated herein by reference.

9. The method of any one of aspects 1 to 8, wherein the human has received a human PDGF-B or PDGFR-B antagonist prior to administering said anti-VEGF-A ligand.

10. The method of any one of aspects 1 to 9, wherein the condition is selected from the group consisting of angiogenesis, neovascularisation, ocular vascularisation and solid tumour vascularisation.

In an example, the condition is subretinal neovascularisation.

11. The method of any one of aspects 1 to 9, wherein the disease or condition is an angiogenic disease or condition.

Optionally the disease or condition is an angiogenic ocular condition or angiogenic cancer, eg a solid tumour, a gastrointestinal cancer, colorectal cancer, liver cancer, breast cancer, ovarian cancer, non small cell lung cancer, thyroid cancer, an oral cancer, or an haematological cancer.

Optionally the angiogenic disease or condition is selected from the group consisting of psoriasis, rheumatoid arthritis, a hemangioma, an angiofibroma, diabetic retinopathy, corneal neovacularisation and neovascular glaucoma.

12. The method of any one of aspects 1 to 11, wherein the disease or condition is or comprises vascular permeability (eg, ocular vascular permeability), edema or inflammation in said human.

For example, the disease or condition is selected from the group consisting of brain edema (eg, edema associated with brain injury, stroke or brain tumour); edema associated with an inflammatory disorder (eg, associated with psoriasis or arthritis, rheumatoid arthritis or asthma); edema associated with burns; ascites or pleural effusion (eg, associated with tumours, inflammation or trauma); chronic airway inflammation; capillary leak syndrome; sepsis; kidney disease (eg, associated with increased leakage of protein); and an eye disorder (eg, age related macular degeneration or diabetic retinopathy).

13. The method of any one of aspects 1 to 12 for reducing or reducing the risk of VEGF-A mediated endothelial cell maintenance or proliferation in an angiogenic disease or condition in said human.

In an example, the angiogenic disease or condition is an angiogenic disease or condition recited above, eg, an angiogenic ocular condition.

14. The method of any one of aspects 1 to 12 for regressing neovascularisation in a VEGF-A mediated disease or condition in said human.

15. The method of any one of aspects 1 to 12 for treating or reducing the risk of neovascularisation in a human, wherein the human has VEGF-A ligand-refractory neovascularisation.

For example, the human is partially or completely resistant to treatment with an anti-VEGF-A ligand, eg, aflibercept, sunitinib, bevacizumab or ranizumab.

16. The method of any one of aspects 1 to 15, comprising antagonising angiopoietin-2 (Ang2) in said human.

The angiopoietins are ligands for the endothelial cell receptor Tie2 and are essential for vascular development and angiogenesis. Unlike other family members, angiopoietin-2 (Ang2) is strongly up-regulated by endothelial cells at sites of angiogenesis and vascular remodelling, including tumours. Enhanced anti-tumour effects have been observed in preclinical models with combined blockade of both VEGF and Ang2.

In an example, the method comprises administering nesvacumab (Regeneron Pharmaceuticals, Inc) to the human.

17. The method of aspect 16, wherein the method comprises administering an anti-Ang2 ligand (eg, nesvacumab) to the human simultaneously or sequentially with the anti-VEGF-A ligand.

In an example, the anti-Ang2 ligand comprises or consists of an anti-Ang2 antibody or fragment, an anti-Ang2 trap, an anti-Ang2 aptamer or an anti-Ang2 NCE (so-called New Chemical Entity in the art).

18. The method of aspect 16, wherein an anti-Ang2 receptor (eg, anti-human Tie2) ligand is administered to the human simultaneously or sequentially with the anti-VEGF-A ligand.

19. The method of any one of aspects 1 to 18, wherein the human has received a human Ang2 or Ang2 receptor (eg, Tie2) antagonist prior to administering said anti-VEGF-A ligand.

20. An anti-TOI (eg, VEGF-A) ligand (eg, an antibody, antibody fragment or TOI trap) for use in a method of any one of aspects 1 to 19.

21. The ligand of aspect 20, wherein the ligand is a human anti-VEGF-A antibody, antibody fragment or VEGF-A trap (eg, aflibercept).

22. The ligand of aspect 20 or 21, wherein said ligand is for intravenous or subcutaneous administration and/or is comprised in an injectable preparation.

General Optional Features Applicable to All Examples, Embodiments, Concepts & Aspects There is optionally provided the method or ligand wherein the anti-TOI (eg, VEGF-A) ligand (eg, an antibody, antibody fragment or TOI trap) comprises a human gamma-1 heavy chain constant region that comprises an Asp corresponding to position 204 of SEQ ID NO: 42 or a Leu corresponding to position 206 of SEQ ID NO: 42 and wherein said human comprises (i) an IGHG1*01 human heavy chain constant region gene segment, or the human expresses antibodies comprising human gamma-1 heavy chain constant regions comprising an Asp corresponding to position 204 of SEQ ID NO: 42 or a Leu corresponding to position 206 of SEQ ID NO: 42.

For example, the ligand is a VEGF-A trap comprising one or more human VEGF-A receptor domain sequences fused to a human gamma-1 heavy chain constant region, eg, a constant region as defined in the immediately preceding paragraph. In an example, such a trap comprises first and second (eg, comprises only two) VEGF-A receptor domain sequences, eg, first and second human Flt1 domain sequences; or first and second human KDR domain sequences; or a Flt domain sequence and a KDR domain sequence. In an example, the trap comprises a human Flt1 Ig-like C2-type 2 domain sequence and a human KDR Ig-like C2-type 3 domain sequence (eg, in this order in the N- to C-terminal direction).

In one embodiment, the ligand of the invention is a VEGF-A trap comprising or of SEQ ID NO: 127, eg, comprising or consisting of a dimer of SEQ ID NO: 127.

In an example, the condition is an ophthalmic angiogenic disorder.

In an example, the condition is selected from the group consisting of AMD, age-related macular degeneration; BRVO, branch retinal vein occlusion; CNV, choroidal neovascularization; mCNV, choroidal neovascularization caused by pathologic myopia; CRVO, central retinal vein occlusion; DME, diabetic macular edema; glaucoma; Macular edema; PCV, polypoidal choroidal vasculopathy; RAP, retinal angiomatous proliferation; retinal neovascularisation; ROP, retinopathy of prematurity; and RVO, retinal vein occlusion.

In an example, the condition is exudative AMD.

In an example, the method is for the treatment of Adult-Onset Vitelliform Detachments Associated With Pattern Dystrophy.

In an example, the method is for the treatment of Pattern Dystrophy.

In an example, the method is for the treatment of Sub-Retinal Fibrosis in Neovascular AMD, eg, by administering Fovista® (an anti-PDGF BB) plus the anti-VEGF ligand (eg, aflibercept, becavizumab or ranibizumab).

In an example, the human is aged ≥50 years, eg, the human is more than 55, 60, 65 or 70 years of age.

In an example, the condition is an ocular condition and the anti-VEGF-A ligand is administered in combination with photodynamic therapy (PDT), eg, for treating or preventing PCV.

In an example, the condition is an ocular condition and the anti-VEGF-A ligand is administered in combination with laser treatment and/or IVTA treatment, eg, for treating or preventing DME.

In an example, the condition is an ocular condition and the anti-VEGF-A ligand is administered in combination with laser photocoagulation and/or intravitreal injections of a glucocorticoid.

In an example, the condition is an ocular condition and the anti-VEGF-A ligand is administered in combination with PDT and triamcinolone acetonide. Optionally, the ligand is administered intravitreally.

In an example the human is suffering from hypertension, hyperlipidemia, diabetes mellitus and/or arteriosclerotic vascular disorder. Optionally, the condition is RVO and further optionally the human is greater than 60 years' of age.

In an example, when RVO is mentioned herein, the RVO is ischemic (non-perfusion) or non-ischemic (perfusion) RVO.

In an example, when ROP is mentioned herein, the type-1 ROP.

In an example, the condition is ROP and the anti-VEGF-A ligand is administered in combination with laser treatment.

In an embodiment, the human has a Body Mass Index (BMI)≥30 and/or the human is a cigarette smoker. These are risk factors, eg, wherein the disease or condition is an ocular disease or condition.

Optionally there is less than 3 or 2 or 2 weeks between ocular disease or condition symptom onset and initiation of treatment with the ligand according to the invention.

In an example, the AMD is neovascular (nv) AMD, "wet" AMD or atrophic or "dry" AMD.

In an example, the ocular condition or disease (eg, AMD) is stage IV disease according to the Age-Related Eye Disease Study classification (see, eg, Augood C A et al, "Prevalence of agerelated maculopathy in older Europeans: the European Eye Study (EUREYE)", Arch Ophthalmol. 2006; 124:529e35) when the ligand is administered to the human.

In an embodiment, wherein the disease or condition is an ocular disease or condition (eg, AMD, PCV, DR or CNV), the ligand is administered to the human by intraocular injection, eg, intravitreal injection.

Persistent angiogenesis may cause or exacerbate certain diseases such as psoriasis, rheumatoid arthritis, hemangiomas, angiofibromas, diabetic retinopathy and neovascular glaucoma. An inhibitor of VEGF activity would be useful as a treatment for such diseases and other VEGF-induced pathological angiogenesis and vascular permeability conditions, such as tumor vascularization. Thus, in an embodiment the present invention in Example 5 provides a method (or ligand for use in the method) for treating or reducing the risk of a condition associated with angiogenesis, wherein the condition is psoriasis, rheumatoid arthritis, hemangiomas, angiofibromas, diabetic retinopathy or neovascular glaucoma. In an embodiment the present invention in Example 5 provides a method (or ligand for use in the method) for treating or reducing the risk of tumor vascularization.

By way of example, but not limitation, the method of the invention may be useful in treating a clinical conditions that are characterized by vascular permeability, edema or inflammation such as brain edema associated with injury, stroke or tumor; edema associated with inflammatory disorders such as psoriasis or arthritis, including rheumatoid arthritis; asthma; generalized edema associated with burns; ascites and pleural effusion associated with tumors, inflammation or trauma; chronic airway inflammation; capillary leak syndrome; sepsis; kidney disease associated with increased leakage of protein; and eye disorders such as age related macular degeneration and diabetic retinopathy. Thus, in an embodiment the present invention in Example 5 provides a method (or ligand for use in the method) for treating or reducing the risk of any one of these conditions.

In an example, the method of the present invention comprises sequentially administering multiple doses of a VEGF antagonist to a patient. The methods of the present invention include the administration of multiple doses of a VEGF antagonist to a patient at a frequency of once every 8 or more weeks.

Various administration routes are contemplated for use in the methods of the present invention, including, e.g., topical administration or intraocular administration (e.g., intravitreal administration). The ligand (or pharmaceutical formulation comprising the ligand) may be administered to the patient by any known delivery system and/or administration method. In certain embodiments, the ligand is administered to the patient by ocular, intraocular, intravitreal or subconjunctival injection. In other embodiments, the ligand can be administered to the patient by topical administration, e.g., via eye drops or other liquid, gel, ointment or fluid which contains the ligand and can be applied directly to the eye. Other possible routes of administration include, e.g., intradermal, intramuscular, intraperitoneal, intravenous, subcutaneous, intranasal, epidural, and oral.

The amount of anti-VEGF ligand administered to the patient in each dose is, in most cases, a therapeutically effective amount. As used herein, the phrase "therapeutically effective amount" means a dose of ligand that results in a detectable improvement in one or more symptoms or indicia of an angiogenic eye disorder, or a dose of ligand that inhibits, prevents, lessens, or delays the progression of an angiogenic eye disorder. In the case of an anti-VEGF antibody or a VEGF receptor-based chimeric molecule (eg, VEGF trap, eg, aflibercept) such as VEGFR1R2-FcΔC1(a), a therapeutically effective amount can be from about 0.05 mg to about 5 mg, e.g., about 0.05 mg, about 0.1 mg, about 0.15 mg, about 0.2 mg, about 0.25 mg, about 0.3 mg, about 0.35 mg, about 0.4 mg, about 0.45 mg, about 0.5 mg, about 0.55 mg, about 0.6 mg, about 0.65 mg, about 0.7 mg, about 0.75 mg, about 0.8 mg, about 0.85 mg, about 0.9 mg, about 1.0 mg, about 1.05 mg, about 1.1 mg, about 1.15 mg, about 1.2 mg, about 1.25 mg, about 1.3 mg, about 1.35 mg, about 1.4 mg, about 1.45 mg, about 1.5 mg, about 1.55 mg, about 1.6 mg, about 1.65 mg, about 1.7 mg, about 1.75 mg, about 1.8 mg, about 1.85 mg, about 1.9 mg, about 2.0 mg, about 2.05 mg, about 2.1 mg, about 2.15 mg, about 2.2 mg, about 2.25 mg, about 2.3 mg, about 2.35 mg, about 2.4 mg, about 2.45 mg, about 2.5 mg, about 2.55 mg, about 2.6 mg, about 2.65 mg, about 2.7 mg, about 2.75 mg, about 2.8 mg, about 2.85 mg, about 2.9 mg, about 3.0 mg, about 3.5 mg, about 4.0 mg, about 4.5 mg, or about 5.0 mg of the antibody or receptor-based chimeric molecule.

Dosing Regimens

Specific, non-limiting examples of dosing regimens within the scope of the present invention are as follows for an anti-TOI ligand (eg, anti-VEGF-A antibody or trap, eg, aflibercept):

a. ligand 2 mg (0.05 mL) administered by intravitreal injection once every 4 weeks (monthly).
b. ligand 2 mg (0.5 mL) administered by intravitreal injection once every 4 weeks for the first 8 weeks, followed by 2 mg (0.05 mL) via intravitreal injection once every 8 weeks.
c. ligand 2 mg (0.5 mL) administered by intravitreal injection once every 4 weeks for the first 8 weeks, followed by 2 mg (0.05 mL) via intravitreal injection on a less frequent basis based on visual and/or anatomical outcomes (as assessed by a physician or other qualified medical professional).
d. ligand 2 mg (0.5 mL) administered by intravitreal injection once every 4 weeks for the first 8 weeks, followed by 2 mg (0.05 mL) via intravitreal injection administered pro re nata (PRN) based on visual and/or anatomical outcomes (as assessed by a physician or other qualified medical professional).
e. ligand 2 mg (0.5 mL) administered by intravitreal injection once every 4 weeks for the first 12 weeks, followed by 2 mg (0.05 mL) via intravitreal injection once every 8 weeks.
f. ligand 2 mg (0.5 mL) administered by intravitreal injection once every 4 weeks for the first 12 weeks, followed by 2 mg (0.05 mL) via intravitreal injection on a less frequent basis based on visual and/or anatomical outcomes (as assessed by a physician or other qualified medical professional).
g. ligand 2 mg (0.5 mL) administered by intravitreal injection once every 4 weeks for the first 12 weeks, followed by 2 mg (0.05 mL) via intravitreal injection administered pro re nata (PRN) based on visual and/or anatomical outcomes (as assessed by a physician or other qualified medical professional).
h. ligand 2 mg (0.5 mL) administered by intravitreal injection once every 4 weeks for the first 16 weeks, followed by 2 mg (0.05 mL) via intravitreal injection once every 8 weeks.
i. ligand 2 mg (0.5 mL) administered by intravitreal injection once every 4 weeks for the first 16 weeks, followed by 2 mg (0.05 mL) via intravitreal injection on a less frequent basis based on visual and/or anatomical outcomes (as assessed by a physician or other qualified medical professional).
j. ligand 2 mg (0.5 mL) administered by intravitreal injection once every 4 weeks for the first 16 weeks, followed by 2 mg (0.05 mL) via intravitreal injection administered pro re nata (PRN) based on visual and/or anatomical outcomes (as assessed by a physician or other qualified medical professional).
k. ligand 2 mg (0.5 mL) administered by intravitreal injection once every 4 weeks for the first 20 weeks, followed by 2 mg (0.05 mL) via intravitreal injection once every 8 weeks.
l. ligand 2 mg (0.5 mL) administered by intravitreal injection once every 4 weeks for the first 20 weeks, followed by 2 mg (0.05 mL) via intravitreal injection on a less frequent basis based on visual and/or anatomical outcomes (as assessed by a physician or other qualified medical professional).
m. ligand 2 mg (0.5 mL) administered by intravitreal injection once every 4 weeks for the first 20 weeks, followed by 2 mg (0.05 mL) via intravitreal injection administered pro re nata (PRN) based on visual and/or anatomical outcomes (as assessed by a physician or other qualified medical professional).
n. ligand 2 mg (0.5 mL) administered by intravitreal injection once every 4 weeks for the first 24 weeks, followed by 2 mg (0.05 mL) via intravitreal injection once every 8 weeks.
o. ligand 2 mg (0.5 mL) administered by intravitreal injection once every 4 weeks for the first 24 weeks, followed by 2 mg (0.05 mL) via intravitreal injection on a less frequent basis based on visual and/or anatomical outcomes (as assessed by a physician or other qualified medical professional).
p. ligand 2 mg (0.5 mL) administered by intravitreal injection once every 4 weeks for the first 24 weeks, followed by 2 mg (0.05 mL) via intravitreal injection administered pro re nata (PRN) based on visual and/or anatomical outcomes (as assessed by a physician or other qualified medical professional).
q. ligand 2 mg (0.5 mL) administered by intravitreal injection once every 4 weeks for the first 28 weeks, followed by 2 mg (0.05 mL) via intravitreal injection once every 8 weeks.
r. ligand 2 mg (0.5 mL) administered by intravitreal injection once every 4 weeks for the first 28 weeks, followed by 2 mg (0.05 mL) via intravitreal injection on a less frequent basis based on visual and/or anatomical outcomes (as assessed by a physician or other qualified medical professional).
s. ligand 2 mg (0.5 mL) administered by intravitreal injection once every 4 weeks for the first 28 weeks, followed by 2 mg (0.05 mL) via intravitreal injection administered pro re nata (PRN) based on visual and/or anatomical outcomes (as assessed by a physician or other qualified medical professional).

t. ligand 2 mg (0.05 mL) administered by intravitreal injection as a single initial dose, followed by additional doses administered pro re nata (PRN) based on visual and/or anatomical outcomes (as assessed by a physician or other qualified medical professional).

Variations on the above-described dosing regimens would be appreciated by persons of ordinary skill in the art and are also within the scope of the present invention. For example, the amount of ligand and/or volume of formulation administered to a patient may be varied based on patient characteristics, severity of disease, and other diagnostic assessments by a physician or other qualified medical professional.

When the method or ligand is for treating or reducing the risk of an ocular condition or disease, the method in an example improves the Best Correct Visual Acuity in the human.

Best Corrected Visual Acuity:

Visual function of the eye can be assessed using the ETDRS protocol (The Early Treatment Diabetic Retinopathy Study Group) at 4 meters. Visual Acuity examiners are typically certified to ensure consistent measurement of BCVA.

The method in an example method prevents vision loss of greater than or equal to 15 letters on the ETDRS chart, compared to baseline, at 52 weeks. Additionally or alternatively the method provides one or more of the following: (a) change from baseline to Week 52 in letter score on the ETDRS chart; (b) gain from baseline to Week 52 of 15 letters or more on the ETDRS chart; (c) change from baseline to Week 52 in total NEI VFQ-25 score; and (d) change from baseline to Week 52 in CNV area (eg, where the condition is CNV).

In one embodiment, the ligand is an VEGF antagonist that comprises one or more VEGF receptor-based chimeric molecule(s), (also referred to herein as a "VEGF-Trap" or "VEGFT"). An exemplary VEGF antagonist that can be used in the context of the present invention is a multimeric VEGF-binding protein comprising two or more VEGF receptor-based chimeric molecules referred to herein as "VEGFR1R2-FcAC1(a)" or "aflibercept."

Various ligand or antibody administration routes are contemplated for use in the methods of the present invention, including, e.g., topical administration or intraocular administration (e.g., intravitreal administration).

The methods of the invention optionally comprise sequentially administering to a patient multiple doses of a ligand, eg, VEGF antagonist. As used herein, "sequentially administering" means that each dose of ligand is administered to the patient at a different point in time, e.g., on different days separated by a predetermined interval (e.g., hours, days, weeks or months). The present invention includes methods which comprise sequentially administering to the patient a single initial dose of a ligand, followed by one or more secondary doses of the ligand, followed by one or more tertiary doses of the ligand.

The terms "initial dose," "secondary doses," and "tertiary doses," refer to the temporal sequence of administration of the ligand. Thus, the "initial dose" is the dose which is administered at the beginning of the treatment regimen (also referred to as the "baseline dose"); the "secondary doses" are the doses which are administered after the initial dose; and the "tertiary doses" are the doses which are administered after the secondary doses. The initial, secondary, and tertiary doses may all contain the same amount of ligand, but will generally differ from one another in terms of frequency of administration. In certain embodiments, however, the amount of ligand contained in the initial, secondary and/or tertiary doses will vary from one another (e.g., adjusted up or down as appropriate) during the course of treatment.

Example 6

PD-L1 & PD-1

Application of PD-L1 Variation in the Present Invention

Human PD-L1 is also known as CD274, B7-H, B7H1, B7-H1, B7 homolog 1, MGC142294, MGC142296, PDCD1L1, PDCD1LG1, PDCD1 ligand 1, PDL1, Programmed cell death 1 ligand 1 and Programmed death ligand 1; and has Uniprot number Q9NZQ7 and NCBI gene ID number 29126. PD-L1 is a 290 amino acid type I transmembrane protein encoded by the CD274 gene on human chromosome 9. PD-L1 expression is implicated in evasion of immune responses involved in chronic infection, e.g., by viruses (including, for example, HIV, HBV, HCV and HTLV, among others), by bacteria (including, for example, *Helicobacter pylori*, among others) and by parasites (including, for example, *Schistosoma mansoni*). CD274/PD-L1 expression is also implicated in suppression of anti-tumour immune activity. Tumours express antigens that can be recognized by host T cells, but immunologic clearance of tumours is rare. Part of this failure is due to immune suppression by the tumour microenvironment. PD-L1 expression on many tumours is a component of this suppressive milieu and may act in concert with other immunosuppressive signals. PD-L1 expression has been shown in situ on a wide variety of solid tumours including breast, lung, colon, ovarian, melanoma, bladder, liver, salivary, stomach, gliomas, thyroid, thymic epithelial, head, and neck (Brown J A et al., 2003. J. Immunol. 170:1257-66; Dong H et al. 2002. Nat. Med. 8:793-800; Hamanishi J, et al. 2007. Proc. Natl. Acad. Sci. USA 104: 3360-65; Strome S E et al. 2003. Cancer Res. 63:6501-5; Inman B A et al. 2007. Cancer 109:1499-505; Konishi J et al. 2004. Clin. Cancer Res. 10:5094-100; Nakanishi J et al. 2007. Cancer Immunol. Immunother. 56:1173-82; Nomi T et al. 2007. Clin. Cancer Res. 13:2151-57; Thompson R H et al. 2004. Proc. Natl. Acad. Sci. USA 101:17174-79; Wu C, Zhu Y, Jiang J, Zhao J, Zhang X G, Xu N. 2006. Acta Histochem. 108:19-24). In addition, PD-1 expression is upregulated on tumour infiltrating lymphocytes, and this may also contribute to tumour immunosuppression (Blank C et al. 2003. J. Immunol. 171:4574-81). In ovarian cancer, PD-L1 expression is inversely correlated with intraepithelial, but not stromal, infiltrating CD8 T cells, suggesting that PD-L1 inhibits the intra-tumor migration of CD8 T cells (Hamanishi J et al. 2007. Proc. Natl. Acad. Sci. USA 104:3360-65). Translation of PD-L1 mRNA is enhanced by loss of PTEN and the ensuing activation of Akt, a common event in tumourigenesis (Parsa A T et al. 2007. Nat. Med. 13:84-88). Most importantly, studies relating PD-L1 expression on tumours to disease outcome show that PD-L1 expression strongly correlates with unfavorable prognosis in kidney, ovarian, bladder, breast, gastric, and pancreatic cancer (Hamanishi J et al. 2007. Proc. Natl. Acad. Sci. USA 104:3360-65; Inman B A et al. 2007. Cancer 109:1499-505; Konishi J et al. 2004. Clin. Cancer Res. 10:5094-100; Nakanishi J et al. 2007. Cancer Immunol. Immunother. 56:1173-82; Nomi T et al. 2007. Clin. Cancer Res. 13:2151-57; Thompson R H et al. 2004. Proc. Natl. Acad. Sci. USA 101:17174-79; Wu C, Zhu Y, Jiang J, Zhao J, Zhang X G, Xu N. 2006. Acta Histochem. 108:19-24). In addition, these studies suggest that higher levels of PD-L1 expression on tumours may facilitate advancement of tumour stage and invasion into deeper tissue structures.

The PD-1 pathway can also play a role in hematologic malignancies. PD-L1 is expressed on multiple myeloma cells but not on normal plasma cells (Liu J et al. 2007. Blood 110:296-304). PD-L1 is expressed on some primary T cell lymphomas, particularly anaplastic large cell T lymphomas (Brown J A et al., 2003. J. Immunol 170:1257-66). PD-1 is highly expressed on the T cells of angioimmunoblastic lymphomas, and PD-L1 is expressed on the associated follicular dendritic cell network (Dorfman D M et al. 2006. Am. J. Surg. Pathol. 30:802-10). In nodular lymphocyte-predominant Hodgkin lymphoma, the T cells associated with lymphocytic and/or histiocytic (L&H) cells express PD-1. Microarray analysis using a readout of genes induced by PD-1 ligation suggests that tumour-associated T cells are responding to PD-1 signals in situ in Hodgkin lymphoma (Chemnitz J M et al. 2007. *Blood* 110:3226-33). PD-1 and PD-L1 are expressed on CD4 T cells in HTLV-1-mediated adult T cell leukemia and lymphoma (Shimauchi T et al. 2007. *Int. J. Cancer* 121: 2585-90). These tumour cells are hyporesponsive to TCR signals.

Studies in animal models demonstrate that PD-L1 on tumours inhibits T cell activation and lysis of tumour cells and in some cases leads to increased tumour-specific T cell death (Dong H et al. 2002. *Nat. Med.* 8:793-800; Hirano F et al. 2005. *Cancer Res.* 65:1089-96). Tumour-associated APCs can also utilize the PD-1:PD-L pathway to control antitumor T cell responses. PD-L1 expression on a population of tumour-associated myeloid DCs is upregulated by tumour environmental factors (Curiel T J et al. 2003. *Nat. Med.* 9:562-67). Plasmacytoid dendritic cells (DCs) in the tumour-draining lymph node of B16 melanoma express IDO, which strongly activates the suppressive activity of regulatory T cells. The suppressive activity of IDO-treated regulatory T cells required cell contact with IDO-expressing DCs (Sharma M D et al. 2007. *J. Clin. Invest.* 117:2570-82).

U.S. Pat. No. 8,507,663 discusses the specific inhibition of the expression of the CD274/PD-L1 gene. Reference is also made to WO2011066389, WO2010036959, WO 2010077634, WO 03099196, WO 2013181634, WO2007005874, US20090317368 and U.S. Pat. No. 7,635,757.

The inventor carried out natural human variation in PD-L1 and identified the following variations of interest for application to the present invention.

TABLE 21

Human PD-L1 Variation

| SNP/ VARIANT | CHROMOSOMAL LOCATION (FORWARD STRAND) | NUCLEOTIDE CHANGE[1] | AMINO ACID CHANGE[2] | AMINO ACID POSITIONS[3] | CUMULATIVE FREQUENCY[4] |
|---|---|---|---|---|---|
| rs150439231 | 9:5448539 | | | | |
| rs138261640 | 9:5448573 | | | | |
| rs142983488 | 9:5448634 | | | | |
| rs76741468 | 9:5448641 | | | | |
| rs822336 | 9:5448690 | | | | |
| rs183400620 | 9:5448763 | | | | |
| rs187252832 | 9:5448815 | | | | |
| rs146143976 | 9:5448859 | | | | |
| rs139023765 | 9:5448896 | | | | |
| rs73641615 | 9:5448956 | | | | |
| rs17718883 | 9:5462876 | | P/R | 146 | |
| rs139709512 | 9:5456126 | | A/P | 5 | |
| rs140045210 | 9:5462881 | | T/S | 148 | |
| rs141978642 | 9:5466785 | | V/E | 269 | |
| rs146495642 | 9:5462929 | G > A | E/K | 164 | |
| rs370800260 | 9:5457087 | G > A | V/I | 21 | |
| rs143235887 | 9:5457091 | C > T | T/M | 22 | |
| rs373692552 | 9:5457117 | G > C | E/Q | 31 | |
| rs140304675 | 9:5457127 | G > C | S/T | 34 | |
| rs12551333 | 9:5457171 | G > C | D/H | 49 | |
| rs376993991 | 9:5457282 | C > T | R/W | 86 | |

TABLE 21-continued

Human PD-L1 Variation

| SNP/ VARIANT | CHROMOSOMAL LOCATION (FORWARD STRAND) | NUCLEOTIDE CHANGE[1] | AMINO ACID CHANGE[2] | AMINO ACID POSITIONS[3] | CUMULATIVE FREQUENCY[4] |
|---|---|---|---|---|---|
| rs367921713 | 9:5462893 | G > A | E/K | 152 | |
| rs41280721 | 9:5462997 | A > C | R/S | 186 | |
| rs61752860 | 9:5465514 | A > T | H/L | 233 | |
| rs148141792 | 9:5465595 | G > A | R/H | 260 | |
| rs369350813 | 9:5467858 | C > T | T/M | 290 | |
| rs10481593 | 9:5458095 | | | | |
| rs2282055 | 9:5455732 | | | | |
| rs2297135 | 9:5470108 | | | | |
| rs2297136 | 9:5467955 | | | | |
| rs2297137 | 9:5465732 | | | | |
| rs3780395 | 9:5464552 | | | | |
| rs7023227 | 9:5456550 | | | | |
| rs1411262 | 9:5459419 | 8923 A > C C > T 6777 C > G | | | |
| rs4143815 | 9:5468257 | 395 G > C | | | |
| rs34028061 | 9:5454629-5454630 | AT > — | deletion | | 0.476 |
| rs7041009 | 9:5463243 | G > A | | | 0.459 |
| rs148170925 | 9:5454642-5454643 | TG > — | deletion | | 0.600 |
| rs1411262 | 9:5459419 | C/T | | | 0.395 |
| rs10114060 | 9:5461729 | G/A | | | 0.382 |
| rs1536926 | 9:5463988 | G/T | | | 0.360 |
| rs7042084 | 9:5458035 | G/T | | | 0.352 |

[1,2,3,4]According to Ensembl, dbSNP; with reference to transcript ENST00000381577 (the sequence of this transcript being incorporated herein in its entirety).

The table is to read as follows: For example, the following for rs12551333 means Asp49His, ie, a histidine at position 49 encoded by SNP rs12551333

| D/H | 49 |
|---|---|

REFERENCES

1. Asia Pac J Clin Oncol. 2014 June; 10(2):e1-6. doi: 10.1111/ajco.12037. Epub 2012 Nov. 21; "Association between single nucleotide polymorphism of PD-L1 gene and non-small cell lung cancer susceptibility in a Chinese population"; Chen Y et al.

The authors published the following:—

Aim:

To evaluate the correlation between a polymorphism of PD-L1 gene and the susceptibility of non-small cell lung cancer (NSCLC) in a Chinese population.

Methods:

A total of 293 Chinese patients with NSCLC and 293 age and sex matched controls of the same ethnic origin were enrolled in this study. A/C polymorphism at position 8923 in intron 4 of PD-L1 gene was typed using the polymerase chain reaction-restriction fragment length polymorphism method (PCR-RFLP). The interactions between A/C genotype, allele frequency and NSCLC susceptibility were analyzed.

Results:

The A/C genotype frequencies were significantly different between NSCLC patients and controls. The AC and CC frequencies were higher in NSCLC patients than in controls (16.4 vs 8.9%, 1.0 vs 0.3%, respectively). The C-allele frequency was higher in NSCLC patients than in controls (9.2 vs 4.8%). Significant differences in the A and C allele frequencies were noted between the two groups ($\chi(2)$ =8.864, P=0.003). More risk of NSCLC was found in individuals carrying the C allele than in those carrying the A allele (OR=2.203; 95% CI 1.262-3.242). In both light smokers (≤20 pack-years) and heavy smokers (>20 pack-years), individuals carrying the C-allele had more risk of NSCLC than those carrying the A-allele (light smokers OR=1.847, 95% CI 1.001-3.409; heavy smokers OR=3.252, 95% CI 1.196-8.845, respectively).

Conclusion:
An A/C polymorphism at position 8923 in the PD-L1 gene is associated with NSCLC susceptibility. The PD-L1 polymorphism plays a role in NSCLC, especially in patients with the C-allele.

2. Eur J Endocrinol. 2008 June; 158(6):817-22. doi: 10.1530/EJE-07-0649. Epub 2008 Mar. 5. "Association of an A/C single nucleotide polymorphism in programmed cell death-ligand 1 gene with Graves' disease in Japanese patients"; Hayashi M et al.

The authors published the following:—

Objective:
Programmed cell death-1 (PD-1) and its ligands (PD-L1 and PD-L2) inhibit T-cell proliferation and activation. This inhibition down-regulates the immune responses. The association of a PD-L1 polymorphism with Graves' disease (GD) was studied.

Design:
The association of an A/C polymorphism at position 8923 in PD-L1 intron 4 with GD was studied.

Patients:
The study included 327 GD patients and 192 controls, of which 252 GD patients were followed over 5-10 years.

Measurements:
PD-L1 intron 4 position 8923 A/C polymorphism was typed using the PCR-restriction fragment length polymorphism method.

Results:
The A/C genotype frequencies were significantly different between GD patients and controls. The A/C and C/C frequencies were higher in GD patients than in controls. The A/A frequencies were lower in GD patients than in controls. C-allele frequency was higher in GD patients than in controls. A total of 252 GD patients were followed over 5-10 years; 200 had discontinued antithyroid drugs (ATD) while 52 continued to take ATD. Of these 200, 176 continued to be in remission and 24 had relapsed into hyperthyroidism. Significant differences in the duration of positive TBII, positive thyroid-stimulating antibodies, and ATD treatment were noted between the patients in remission and those that had relapsed. Significant differences in the A- and C-allele frequencies were noted between the two. The C-allele frequency was higher in GD patients who did not achieve remission than in those who achieved remission.

Conclusion:
An A/C polymorphism at position 8923 in PD-L1 is associated with GD. The PD-L1 polymorphism plays a role in GD development. GD patients with the C allele at position 8923 in PD-L1 gene had difficulty in achieving remission.

3. Rheumatology (Oxford). 2011 October; 50(10):1809-13. doi: 10.1093/rheumatology/ker211. Epub 2011 Jul. 26; "Effects of genetic polymorphisms of programmed cell death 1 and its ligands on the development of ankylosing spondylitis"; Huang C et al.

Human subjects with the PD-1 GG genotype had significantly greater risk for ankylosing spondylitis (AS) than those with the AA genotype. Subjects with the PD-L2 CT genotype had lower risk for AS than those with the CC genotype. The combined genotypes of PD-1 G-536A, PD-L1 A8923C and PD-L2 C47103T also appear to be associated with AS development.

Conclusions.
The results suggest that PD-1 G-536A, PD-L1 A8923C and PD-L2 C47103T polymorphisms are associated with the presence of AS.

4. J Clin Endocrinol Metab. 2009 December; 94(12):5139-45. doi: 10.1210/jc.2009-1404. Epub 2009 Oct. 22; "Programmed death ligand 1 (PD-L1) gene variants contribute to autoimmune Addison's disease and Graves' disease susceptibility"; Mitchell A L et al.

The authors published the following:—

Context:
Despite much investigation, a substantial amount of the genetic susceptibility to autoimmune diseases remains unaccounted for. Recently, a single-nucleotide polymorphism (SNP) in the programmed death ligand 1 (PD-L1) gene has been associated with Graves' disease (GD) in a Japanese patient cohort. Our aim was to determine whether variants in PD-L1 are also associated with autoimmune Addison's disease (AAD) and to replicate the previous association in patients with GD from the United Kingdom.

Design and Patients:
We analyzed eight SNPs within PD-L1 in a United Kingdom cohort of 315 AAD subjects and 316 healthy controls. We then replicated our experiment in a cohort of 342 Norwegian AAD cases and 379 controls and in 496 United Kingdom GD subjects.

Results:
Three of the eight SNPs studied, part of a haplotype block in the PD-L1 gene, showed modest association with both AAD and GD in the United Kingdom cohort, with maximum evidence at the marker RS1411262 [United Kingdom AAD odds ratio 1.33 (5-95% confidence interval 1.02-1.73), P(genotype)=0.028; GD odds ratio 1.36 (5-95% confidence interval 1.07-1.72), P(genotype)=0.033]. Association with genotypes at the same three markers was confirmed in the Norwegian AAD cohort [P(genotype)=0.011-0.020]. A recessive effect at the most associated alleles was observed in both the AAD and GD cohorts.

Conclusions:
We confirm the role of PD-L1 variants in GD susceptibility and extend these findings to demonstrate association in two Northern European patient cohorts with AAD. PD-L1 joins the growing number of known susceptibility loci exerting modest effects in these autoimmune disorders.

5. J Clin Immunol. 2007 November; 27(6):563-7. Epub 2007 Jun. 28; "Polymorphisms of genes for programmed cell death 1 ligands in patients with rheumatoid arthritis"; Wang S C et al.

The authors published the following:—

To investigate the role of ligands for programmed cell death 1 (PD-L) in the pathogenesis of rheumatoid arthritis (RA), 129 patients with RA and 125 unrelated healthy controls were enrolled in this study. The PD-L1 and PD-L2 polymorphisms were determined by the method of polymerase chain reaction (PCR)/direct sequencing or PCR/reaction fragment length polymorphisms. The genotype distributions of PD-L1 6777 C/G were not significantly different between the patients with RA and healthy controls. There was also no significant difference in the allele frequencies of PD-L1 6777 C/G polymorphisms between the patients with RA and controls. Similar findings could also be found in the phenotypes and alleles frequencies of PD-L2 47103 C/T and 47139 T/C polymorphisms between the patients with RA and controls. The patients with PD-L1 6777 G had higher prevalence of rheumatoid nodule in comparison with those without PD-L1 6777 G (p=0.005, OR=4.0, 95% CI=1.5-10.9). In contrast, the PD-L2 47103 C/T and 47139 T/C polymorphisms were not related to the occurrence of rheumatoid nodule. This study demonstrated that the PD-L1 and PD-L2 polymorphisms were not associated with susceptibility to RA in Taiwan. PD-L1 6777 G was associated with the prevalence of rheumatoid nodule.

6. Hum Genet. 2013 June; 132(6):641-8. doi: 10.1007/s00439-013-1275-6. Epub 2013 Feb. 21; "A miR-570 binding site polymorphism in the B7-H1 gene is associated with the risk of gastric adenocarcinoma"; Wang W et al.

Since the over-expression of B7-H1 protein has been reported to be closely related to disease progression of gastric cancer, the authors investigated the possible role of miRSNPs at the 3'-untranslated region (3'-UTR) of B7-H1 in the risk of developing gastric cancer. In this association study on 205 gastric adenocarcinoma patients and 393 non-cancer controls, they found that the genotype distribution of a common C>G polymorphism (rs4143815) was significantly different between the cases and controls (P=1.32× 10(−8)). Compared with CC homozygotes, GG homozygotes and G allele carriers showed 3.73-fold (P=2.98×10 (−8)) and 1.85-fold (P=0.002) increased risk of gastric adenocarcinoma, respectively. Stratified analyses indicated that variant genotypes had a strong association with the clinic-pathological features of gastric cancer including differentiation grade, depth of tumor infiltration, and tumor node metastasis (TNM) stage (P<0.001). Luciferase reporter assay indicated that this SNP might be responsible for aberrant B7-H1 protein expression in gastric cancer by disrupting the interaction between miR-570 and B7-H1 mRNA. These results are consistent with our hypothesis and indicate that genetic polymorphisms influencing B7-H1 expression modify cancer susceptibility.

7. Clinical cancer research: an official journal of the American Association for Cancer Research/15(3):971-9; Pub Date: Feb. 1, 2009; "Overexpression of PD-L1 significantly associates with tumor aggressiveness and postoperative recurrence in human hepatocellular carcinoma"; Qiang G et al.

The authors published the following:—

Purpose

The aberrant expression of programmed cell death 1 ligands 1 and 2 (PD-Ls) on tumor cells dampens antitumor immunity, resulting in tumor immune evasion. In this study, we investigated the expression of PD-Ls in human hepatocellular carcinoma (HCC) to define their prognostic significance after curative surgery.

Experimental Design

Immunohistochemistry was used to investigate PD-Ls expression as well as granzyme B+ cytotoxic and FoxP3+ regulatory T cell infiltration on tissue microarrays containing 240 randomly selected HCC patients who underwent surgery. The results were further verified in an independent cohort of 125 HCC patients. PD-Ls expression on HCC cell lines was detected by Western blot assay.

Results

Patients with higher expression of PD-L1 had a significantly poorer prognosis than patients with lower expression. Although patients with higher expression of PD-L2 also had a poorer survival, the difference in recurrence was not statistically significant. Multivariate analysis identified tumor expression of PD-L1 as an independent predictor for postoperative recurrence. No correlation was found between PD-Ls expression and granzyme B+ lymphocyte infiltration, whereas a significant positive correlation was detected between PD-Ls expression and FoxP3+ lymphocyte infiltration. In addition, tumor-infiltrating cytotoxic and regulatory T cells were also independent prognosticators for both survival and recurrence. The prognostic value of PD-L1 expression was validated in the independent data set.

Conclusion

Our data suggest for the first time that PD-L1 status may be a new predictor of recurrence for HCC patients and provide the rationale for developing a novel therapy of targeting the PD-L1/PD-1 pathway against this fatal malignancy.

Using this analysis, the inventor has devised the following aspects of the invention that are useful for addressing PD-L1-mediated diseases and conditions, such as cancer, autoimmune or inflammatory diseases and conditions as more fully described below. Thus, the invention provides the following aspects.

In an example, the invention provides a method of treating or reducing the risk of a PD-L1-mediated disease or condition in a human in need thereof, the method comprising administering to said human a ligand (eg, an antibody or antibody fragment) that specifically binds a human PD-L1 protein. The invention also provides a corresponding ligand. In an embodiment, the PD-L1 is encoded by a PD-L1 nucleotide sequence comprising a variation set out in Table 21, eg, comprising one or more of said SNPs (eg, RS1411262 and/or rs4143815; or 8923C and/or 395C). In a preferred embodiment, the variation is 8923C.

The present invention provides anti-PD-L1 ligands; and PD-L1-binding or targeting ligands as described herein. The ligands have a variety of utilities. Some of the ligands, for instance, are useful in specific binding assays, for genotyping or phenotyping humans, affinity purification of PD-L1, in particular human PD-L1 or its ligands and in screening assays to identify other antagonists of PD-L1 activity. Some of the ligands of the invention are useful for inhibiting PD-L1-mediated activities.

Anti-PD-L1 ligands (eg, antibodies and anti-sense RNA) have been developed based on targeting and neutralising so-called "wild-type" human PD-L1, which is a commonly-occurring form. While such therapies are useful for human patients harbouring this form of human PD-L1, the inventor considered it useful to investigate the possibility of targeting rarer—but still naturally-occurring—forms of PD-L1 amongst human populations. In this way, the inventor arrived at insight into the natural occurrences and distributions of rarer human PD-L1 forms that can serve as useful targets (at the protein or nucleic acid level) for human treatment, prophylaxis and diagnosis pertinent to diseases and conditions mediated or associated with PD-L1 activity. This particularly provides for tailored therapies, prophylaxis and diagnosis in humans that are devoid of the common PD-L1 gene or protein.

The skilled person will know that SNPs or other changes that translate into amino acid variation can cause variability in activity and/or conformation of human targets to be addressed. This has spawned great interest in personalized medicine where genotyping and knowledge of protein and nucleotide variability is used to more effectively tailor medicines and diagnosis of patients. The invention, therefore, provides for tailored pharmaceuticals and testing that specifically addresses rarer PD-L1 polymorphic variant forms. Such forms or "alleles" (at the nucleotide level), comprise one or more changes at the nucleotide and amino acid levels from the corresponding common form nucleotide and amino acids sequences, ie, there are one or more non-synonymous (aka "missense") changes at the nucleotide level that translate into one or more corresponding changes in the protein target in humans.

Furthermore, the inventor surprisingly realised that the rarer natural forms, although present in humans at much lower frequencies than the common form, nevertheless are represented in multiple and ethnically-diverse human populations and usually with many human examples per represented ethnic population. Thus, the inventor realised that targeting such rarer forms would provide for effective treatment, prophylaxis or diagnosis across many human ethnic populations, thereby extending the utility of the present invention. In particular, human PD-L1 variations are correlated with increased incidence or risk of PD-L1 mediated diseases or conditions, such as cancer. The inventor analysed such variations and devised the collections of variants in Table 21. In this respect, therefore, the invention provides various aspects and aspects as set out below in this example.

The inventor saw that there is significant industrial and medical application for the invention in terms of guiding the choice of anti-TOI (PD-L1) ligand for administration to human patients for therapy and/or prophylaxis of PD-L1-mediated or associated diseases or conditions. In this way, the patient receives drugs and ligands that are tailored to their needs—as determined by the patient's genetic or phenotypic makeup. Hand-in-hand with this, the invention provides for the genotyping and/or phenotyping of patients in connection with such treatment, thereby allowing a proper match of drug to patient. This increases the chances of medical efficacy, reduces the likelihood of inferior treatment using drugs or ligands that are not matched to the patient (eg, poor efficacy and/or side-effects) and avoids pharmaceutical mis-prescription and waste.

In developing this thinking, in a non-limiting embodiment the present inventor decided to determine a set of human PD-L1 variants on the basis of the following criteria, these being criteria that the inventor realised would provide for useful medical drugs and diagnostics to tailored need in the human population. In an embodiment the inventor selected variants having at least 3 of the 4 following criteria:—

Naturally-occurring human TOI variation having a cumulative human allele frequency of 49 or 35% or less;
Naturally-occurring human TOI variation having a total human genotype frequency of about 50% or less;
Naturally-occurring human TOI variation found in many different human ethnic populations (using the standard categorisation of the 1000 Genomes Project; see Table 2 below); and
Naturally-occurring human TOI variation found in many individuals distributed across such many different ethnic populations.

In an example, the ligand of the invention comprises an anti-human PD-L1 binding site, wherein the binding site is a human or humanized binding site, eg, the binding site comprises or consists of a human or humanized antibody variable domain or plurality of variable domains (eg, human VH/VL binding site(s)). Additionally or alternatively, the ligand comprises one or more human antibody constant regions (eg, a human antibody CH1, CH2, CH3 (or all of these) or Fc). In an example, the ligand is an antibody that comprises human or humanized variable regions and human constant regions (eg, bearing one or more mutations to enhance or dampen Fc function in a human patient).

In an example, the invention provides a method of targeting PD-L1 in a human, the method comprising administering to said human a ligand (eg, an antibody or antibody fragment) that specifically binds a human PD-L1 protein that is encoded by a human PD-L1 nucleotide comprising a PD-L1 variation as described herein. In an example, the human is suffering from or at risk of a PD-L1-mediated disease or condition. In an example, the method treats or reduces the risk of a PD-L1-mediated disease or condition in the human.

In an embodiment, (i) the antibody or fragment comprises a VH domain derived from the recombination of a human VH segment, a human D gene segment and a human JH segment, the human VH segment encoding the framework 1 of SEQ ID NO: 40 and wherein said human comprises a VH gene segment encoding the framework 1 of SEQ ID NO: 40, or the human expresses VH domains that comprise the framework 1 of SEQ ID NO: 40.

Preferably, additionally or alternatively in an embodiment the anti-PDL-1 ligand (eg, antibody or fragment) comprises a gamma-1 constant region (eg, an IGHG1*01 constant region) as described herein.

Additionally or alternatively, in an embodiment, (i) the antibody or fragment comprises a human gamma-4 heavy chain constant region that comprises a Leu at position 189 shown in SEQ ID NO: 73 or an Arg at position 289 shown in SEQ ID NO: 73 and wherein said human comprises an IGHG4*01 human heavy chain constant region gene segment, or the human expresses antibodies comprising human gamma-4 heavy chain constant regions comprising a Leu at position 189 shown in SEQ ID NO: 73 or an Arg at position 289 shown in SEQ ID NO: 73.

In a specific embodiment, the anti-PD-L1 ligand, antibody or fragment of present invention comprises an Fc region, wherein the Fc region comprises at least one non-native amino acid residue selected from the group consisting of 234D, 234E, 234N, 234Q, 234T, 234H, 234Y, 234I, 234V, 234F, 235A, 235D, 235R, 235W, 235P, 235S, 235N, 235Q, 235T, 235H, 235Y, 235I, 235V, 235F, 236E, 239D, 239E, 239N, 239Q, 239F, 239T, 239H, 239Y, 240I, 240A, 240T, 240M, 241W, 241 L, 241Y, 241E, 241 R. 243W, 243L 243Y, 243R, 243Q, 244H, 245A, 247L, 247V, 247G, 251F, 252Y, 254T, 255L, 256E, 256M, 262I, 262A, 262T, 262E, 263I, 263A, 263T, 263M, 264L, 264I, 264W, 264T, 264R, 264F, 264M, 264Y, 264E, 265G, 265N, 265Q, 265Y, 265F, 265V, 265I, 265L, 265H, 265T, 266I, 266A, 266T, 266M, 267Q, 267L, 268E, 269H, 269Y, 269F, 269R, 270E, 280A, 284M, 292P, 292L, 296E, 296Q, 296D, 296N, 296S, 296T, 296L, 296I, 296H, 269G, 297S, 297D, 297E, 298H, 298I, 298T, 298F, 299I, 299L, 299A, 299S, 299V, 299H, 299F, 299E, 305I, 313F, 316D, 325Q, 325L, 325I, 325D, 325E, 325A, 325T, 325V, 325H, 327G, 327W, 327N, 327L, 328S, 328M, 328D, 328E, 328N, 328Q, 328F, 328I, 328V, 328T, 328H, 328A, 329F, 329H, 329Q, 330K, 330G, 330T, 330C, 330L, 330Y, 330V, 330I, 330F, 330R, 330H, 331G, 331A, 331L, 331M, 331F, 331W, 331K, 331Q, 331E, 331S, 331V, 331I, 331C, 331Y, 331H, 331R, 331N, 331D, 331T, 332D, 332S, 332W, 332F, 332E, 332N, 332Q, 332T, 332H, 332Y, 332A, 339T, 370E, 370N, 378D, 392T, 396L, 416G, 419H, 421K, 440Y and 434W as numbered by the EU index as set forth in Kabat. Optionally, the Fc region may comprise additional and/or alternative non-native amino acid residues known to one skilled in the art (see, e.g., U.S. Pat. Nos. 5,624,821; 6,277,375; 6,737,056; PCT Patent Publications WO 01/58957; WO 02/06919; WO 04/016750; WO 04/029207; WO 04/035752 and WO 05/040217).

The ligand, antibody or fragment according to the invention (eg, an anti-PD-L1 antibody or fragment) is for treating or preventing or reducing the risk of (or treats or prevents or reduces the risk of), for example, any disease or condition disclosed in U.S. Pat. No. 8,507,663, WO2011066389, WO2010036959, WO 2010077634, WO 03099196, WO 2013181634, WO2007005874, US20090317368 or U.S. Pat. No. 7,635,757, the disclosure of which diseases and conditions are incorporated herein by reference for potential inclusion in one or more aspects herein. Guidance on obtaining and testing antibodies can also be found in these publications. Suitable anti-PD-L1 ligands, antibodies or fragments for use in the invention are disclosed in these publications, the disclosure of which (including sequences thereof) are incorporated herein by reference for potential inclusion in one or more aspects herein.

Further encompassed by the invention is the use of the anti-PD-L1 ligand, antibody or fragment in the manufacture of a medicament for use to attenuate or inhibit a PD-L1-mediated disease or disorder in a human. PD-L1-mediated or related disorders which are treated by the ligand, antibody or fragment of the invention include, for example, described below.

Thus, a ligand, antibody or fragment of the invention is useful as a therapeutic agent in the treatment of a condition involving PD-L1 expression and/or activity. One embodiment, among others, is a method of treatment comprising administering an effective amount of a ligand, antibody or fragment of the invention to a patient in need thereof, wherein functional consequences of PD-L1 activation are decreased. Another embodiment, among others, is a method of treatment comprising (i) identifying a patient demonstrating PD-L1 expression or activity, and (ii) administering an effective amount of a ligand, antibody or fragment of the invention to the patient, wherein a functional consequence of PD-L1 activation are attenuated. An effective amount according to the invention is an amount that modulates (e.g. decreases) the functional consequences of PD-L1 activation so as to modulate (e.g. decrease or lessen) the severity of at least one symptom of the particular disease or disorder being treated, but not necessarily cure the disease or disorder. Accordingly, one embodiment of the invention is a method of treating or reducing the severity of at least one symptom of any of the disorders referred to herein, comprising administering to a patient in need thereof an effective amount of one or more ligands, antibodies or fragments of the present invention alone or in a combined therapeutic regimen with another appropriate medicament known in the art or described herein such that the severity of at least one symptom of any of the disorders is reduced. Another embodiment of the invention, among others, is a method of antagonizing at least one effect of PD-L1 comprising contacting with or administering an effective amount of one or more ligands, antibodies or fragments of the present invention such that said at least one effect of PD-L1 is antagonized, e.g. the ability to promote or maintain cancer, an autoimmune condition or an inflammatory condition.

Tailoring Anti-PD-L1 Ligands

As outlined herein (for example, in the context of PCSK9 in Example 1), the invention includes the possibility to tailor treatment of humans further by selecting antibody-based ligands with variable domains and/or constant domains based on gene segments found in many humans of the ethnic populations where the variant TOI forms are found to meet the selection criteria of the invention. This also applies mutatis mutandis where the TOI is human PD-L1 as in the present example. Thus, all disclosure herein relating to tailoring variable and/or constant domains apply to the present example, relating to PD-L1 and is combinable for use in one or more aspects herein.

As described in Example 1, an example is provided for ligands comprising antibody VH domains derived from recombination of human IGHV gene segments comprising selected nucleotides at positions in the HCDR1 or FW3 where there is variability in humans (ie, where SNPs occur in humans).

Further information is provided in Table 4, which shows variation at these positions, as well as the variant distributions across the 1000 Genomes Project database relating to many human populations.

In other embodiments, as explained more fully above, the invention provides for ligands which are tailored to the human recipient's genotype and/or phenotype based on alternative human VH gene segments, or on Vκ, Vλ or constant region gene segments (see further Table 9 for representative variants).

Further examples, therefore are:—
(i) wherein the ligand comprises a VH domain derived from the recombination of a human VH segment (eg, human VH3-23*04), a human D gene segment and a human JH segment, the human VH segment encoding the framework 1 of SEQ ID NO: 40 and wherein said human comprises a VH gene segment encoding the framework 1 of SEQ ID NO: 40, or the human expresses VH domains that comprise the framework 1 of SEQ ID NO: 40.
(ii) wherein the ligand comprises a VH domain derived from the recombination of human VH segment IGHV3-7*01, a human D gene segment and a human JH segment, and wherein said human comprises a IGHV3-7*01 VH gene segment or the human expresses VH domains derived from the recombination of human VH segment IGHV3-7*01, a human D gene segment and a human JH segment.
(iii) wherein the ligand comprises a Vκ domain derived from the recombination of human Vκ segment IGKV1-12*01 and a human Jκ segment, and wherein said human comprises a IGKV1-12*01 Vκ gene segment or the human expresses Vκ domains derived from the recombination of human Vκ segment IGKV1-12*01 and a human Jκ segment.
(iv) wherein the ligand comprises a Vκ domain derived from the recombination of a human Vκ segment and a human Jκ segment, the human Vκ segment encoding (i) a CDR3 comprising a Pro at position 7 shown in SEQ ID NO: 36 and wherein said human comprises a Vκ gene segment encoding a CDR3 comprising a Pro at position 7 shown in SEQ ID NO: 36, or the human expresses Vκ domains that comprise a CDR3 comprising a Pro at position 7 shown in SEQ ID NO: 36; or (ii) a FW3 comprising a Ser at position 15 shown in SEQ ID NO: 38 and wherein said human comprises a Vκ gene segment encoding a FW3 comprising a Ser at position 15 shown in SEQ ID NO: 38 or the human expresses Vκ domains that comprise a FW3 comprising a Ser at position 15 shown in SEQ ID NO: 38.
(v) wherein the ligand comprises a human gamma-1 heavy chain constant region that comprises an Asp at position 204 shown in SEQ ID NO: 4 or a Leu at position 206 shown in SEQ ID NO: 4 and wherein said human comprises (i) an IGHG1*01 human heavy chain constant region gene segment, or the human expresses antibodies comprising human gamma-1 heavy chain constant regions comprising an Asp at position 204 shown in SEQ ID NO: 4 or a Leu at position 206 shown in SEQ ID NO: 4.
(vi) wherein the ligand comprises a human gamma-2 heavy chain constant region that comprises an amino acid selected from the group consisting of a Pro at position 72 shown in SEQ ID NO: 6, an Asn at position 75 shown in SEQ ID NO: 6, a Phe at position 76 shown in SEQ ID NO: 6, a Val at position 161 shown in SEQ ID NO: 6 and an Ala at position 257 shown in SEQ ID NO: 6 and wherein said human comprises (i) an IGHG2*01 human heavy chain constant region gene segment, or the human expresses antibodies comprising human gamma-2 heavy chain constant regions comprising said selected Pro at position 72 shown in SEQ ID NO: 6, Asn at position 75 shown in SEQ ID NO: 6, Phe at position 76 shown in SEQ ID NO: 6, Val at position 161 shown in SEQ ID NO: 6 or Ala at position 257 shown in SEQ ID NO: 6. In an example, the constant region is Fc enhanced, eg, ADCC or CDC enhanced. The skilled person will know techniques (eg, known C region mutations) to enhance ADCC or CDC.

(vii) wherein the ligand comprises a human kappa chain constant region that comprises a Val at position 84 shown in SEQ ID NO: 16 or a Cys at position 87 shown in SEQ ID NO: 16 and wherein said human comprises (i) an IGKC1*01 human kappa chain constant region gene segment, or the human expresses antibodies comprising human kappa chain constant regions comprising a Val corresponding to position 84 shown in SEQ ID NO: 16 or a Cys at position 87 shown in SEQ ID NO: 16.

(viii) wherein the ligand comprises a human IGLC1*01 lambda chain constant region and wherein said human comprises (i) a human IGLC1*01 lambda chain constant region gene segment, or the human expresses antibodies comprising human IGLC1*01 lambda chain constant regions.

(ix) wherein the ligand comprises a human gamma-4 heavy chain constant region that comprises a Leu at position 189 shown in SEQ ID NO: 73 or an Arg at position 289 shown in SEQ ID NO: 73 and wherein said human comprises (i) an IGHG4*01 human heavy chain constant region gene segment, or the human expresses antibodies comprising human gamma-4 heavy chain constant regions comprising a Leu at position 189 shown in SEQ ID NO: 73 or an Arg at position 289 shown in SEQ ID NO: 73.

(x) wherein the ligand comprises a human gamma-3 heavy chain constant region encoded by a first human IGHG3 (eg, IGHG3*01) constant region gene segment and wherein said human comprises (i) said first constant region gene segment (eg, an IGHG3*01), or the human expresses antibodies comprising human gamma-3 heavy chain constant regions encoded by said first human IGHG3 (eg, IGHG3*01) constant region gene segment.

(xi) wherein the ligand comprises a human epsilon heavy chain constant region encoded by a first human epsilon heavy chain constant region gene segment and wherein said human comprises (i) said first constant region gene segment, or the human expresses antibodies comprising human epsilon heavy chain constant regions encoded by said first constant region gene segment.

(xii) wherein the ligand comprises a human mu heavy chain constant region encoded by a first human mu heavy chain constant region gene segment and wherein said human comprises (i) said first constant region gene segment, or the human expresses antibodies comprising human mu heavy chain constant regions encoded by said first constant region gene segment.

(xiii) wherein the ligand comprises a human alpha heavy chain constant region encoded by a first human alpha heavy chain constant region gene segment and wherein said human comprises (i) said first constant region gene segment, or the human expresses antibodies comprising human alpha heavy chain constant regions encoded by said first constant region gene segment.

(xiv) wherein the ligand comprises a human delta heavy chain constant region encoded by a first human delta heavy chain constant region gene segment and wherein said human comprises (i) said first constant region gene segment, or the human expresses antibodies comprising human delta heavy chain constant regions encoded by said first constant region gene segment.

(xv) wherein the ligand comprises a human kappa light chain constant region encoded by a first human kappa light chain constant region gene segment and wherein said human comprises (i) said first constant region gene segment, or the human expresses antibodies comprising human kappa light chain constant regions encoded by said first constant region gene segment.

(xvi) wherein the ligand comprises a human lambda light chain constant region encoded by a first human lambda light chain constant region gene segment and wherein said human comprises (i) said first constant region gene segment, or the human expresses antibodies comprising human lambda light chain constant regions encoded by said first constant region gene segment.

Generally, in an example the ligand comprises a heavy chain constant region that is Fc enhanced, eg, ADCC or CDC enhanced. The skilled person will know techniques (eg, known C region mutations; defucosylation to enhance ADCC) to enhance ADCC or CDC. This applies to any of Examples 1 onwards herein.

Thus, it may be advantageous for PD-L1 ligands, for the ligand to comprise a gamma-1 or gamma-2 constant region (eg, as per the embodiments (i) to (xvi) above). For example, the ligand comprises said gamma-1 constant region, eg, an ADCC or CDC enhanced constant region meeting embodiment (v).

In an example, the ligand (eg, an antibody) is conjugated to a cytokine selected from the group consisting of IL-2, IL-12, IL-15 or IL-21. In an example, the cytokine is IL-2.

In an example, eg, for where the condition is a viral infection, the ligand (eg, antibody) comprises a gamma-4 constant region as herein defined and optionally wherein an Fc inactivated IgG4, such a IgG4(S228P).

Determination of Specific Binding of Ligands of the Invention to PD-L1 Variants

The specific binding of ligands of the invention to PD-L1 variants can be performed using the SPR method described in Example 1.

By way of example, the invention thus provides the following aspects:—

1. A method of treating or reducing the risk of a disease or condition mediated by PD-L1 in a human, the method comprising administering to said human an anti-PD-L1 ligand (eg, an anti-PD-L1 trap, antibody or antibody fragment) that specifically binds to a human PD-L1 that is expressed by a PD-L1 nucleotide sequence comprising a variation selected from the variations listed in Table 21.

For example, there is provided a method of treating or reducing the risk of a disease or condition mediated by PD-L1 in a human, the method comprising administering to said human an anti-PD-L1 ligand (eg, an anti-PD-L1 trap, antibody or antibody fragment) that specifically binds to a human PD-L1 that is expressed by a PD-L1 nucleotide sequence comprising a variation selected from the variations listed in Table 21, wherein said human comprises a PD-L1 nucleotide sequence comprising said selected variation.

For example, there is provided a method of treating or reducing the risk of a cancer in a human, the method comprising administering to said human an anti-PD-L1 ligand (eg, an anti-PD-L1 trap, antibody or antibody fragment) that specifically binds to a human PD-L1 that is expressed by a PD-L1 nucleotide sequence comprising a variation selected from the variations listed in Table 21, wherein said human comprises a PD-L1 nucleotide sequence comprising said selected variation.

For example, there is provided a method of treating or reducing the risk of an autoimmune disease or condition in a human, the method comprising administering to said human an anti-PD-L1 ligand (eg, an anti-PD-L1 trap, antibody or antibody fragment) that specifically binds to a human PD-L1 that is expressed by a PD-L1 nucleotide sequence comprising a variation selected from the variations listed in Table 21, wherein said human comprises a PD-L1 nucleotide sequence comprising said selected variation.

For example, there is provided a method of treating or reducing the risk inflamatory disease or condition in a human, the method comprising administering to said human an anti-PD-L1 ligand (eg, an anti-PD-L1 trap, antibody or antibody fragment) that specifically binds to a human PD-L1 that is expressed by a PD-L1 nucleotide sequence comprising a variation selected from the variations listed in Table 21, wherein said human comprises a PD-L1 nucleotide sequence comprising said selected variation.

Herein, specific binding can be tested using a sample PD-L1 using a routine method known the skilled person, eg, ELISA or SPR (eg, using a method as described herein). For example, the PD-L1 is provided by a sample from said human or another human, eg, a serum or blood sample.

In an example, the ligand comprises an anti-PD-L1 binding site that specifically binds human PD-L1. Optionally, the binding site comprises one or more antibody variable domains or one or more human PD-L1 receptor domains. In an example, specific binding with a Kd of 1 mm or less (ie, 1 mM or stronger binding), eg, 1 nM or less; or 100 pM or less; or 10 pM or less. Specific binding can be determined, for example, by assessing binding of the ligand to PD-L1 in a sample from said human or another human comprising said PD-L1. In an example, the sample comprises serum, blood, feces, tissue, a cell, urine and/or saliva of said human.

In an example, the ligand is selected from the group consisting of wher MEDI4736 (Medimmune), durvalumab, RG-7446 (Genentech, Roche, Chugai, MPDL3280A), MPDL3280A (Genentech), STI-A1014 (Sorrento Therapeutics Inc), MSB-0010718C (Merck Serono); MDX1105 (Bristol-Myers Squibb) and BMS-936559 (Bristol-Myers Squibb). Optionally the ligand is administered in combination with an anti-CTLA-4 ligand (eg, antibody or fragment), eg, Tremelimumab. For example, MEDI4736 or durvalumab is administered in combination with an anti-CTLA-4 ligand (eg, antibody or fragment), eg, Tremelimumab.

In an example, the ligand is an anti-PD-L1 antibody or antibody fragment, eg, durvalumab.

In an example, the ligand is an NCE (so-called New Chemical Entity in the art).

In an example, the human has been diagnosed with said disease or condition before said administration of the ligand.

For example, the human is partially or completely resistant to treatment with an anti-PD-L1 ligand, eg, an anti-PD-L1 NCE.

In an example, the ligand is administered by intravenous or subcutaneous administration and/or is comprised in an injectable preparation.

2. The method of aspect 1, wherein the nucleotide sequence comprises a nucleotide corresponding to SNP rS1411262, SNP rs4143815, 8923C or 395C.

3. The method of aspect 1 or 2, wherein said human comprises a PD-L1 nucleotide sequence comprising said selected variation.

Optionally, the human is homozygous for said variation. Alternatively, the human is heterozygous for said variation.

In an example, the ligand comprises an antibody constant region (eg, an antibody Fc region).

4. The method of any one of aspects 1 to 3, wherein the ligand comprises a human gamma-1 heavy chain constant region that comprises an amino acid selected from the group consisting of an Asp corresponding to position 204 of SEQ ID NO: 42 and a Leu corresponding to position 206 of SEQ ID NO: 42 and optionally wherein said human comprises an IGHG1*01 human heavy chain constant region gene segment, or the human expresses antibodies comprising human gamma-1 heavy chain constant regions comprising said selected amino acid.

For example, the ligand comprises a human gamma-1 heavy chain constant region that comprises an amino acid selected from the group consisting of an Asp corresponding to position 204 of SEQ ID NO: 42 and a Leu corresponding to position 206 of SEQ ID NO: 42 and wherein said human comprises an IGHG1*01 human heavy chain constant region gene segment, or the human expresses antibodies comprising human gamma-1 heavy chain constant regions comprising said selected amino acid. In an embodiment, this is combined with any of the examples set out under aspect 1 above.

Optionally, this constant region of the ligand is comprised by an Fc region, eg, an enhanced Fc region.

Optionally, the ligand comprises an IGHG1*01 human heavy chain constant region.

5. The method of any one of aspects 1 to 4, wherein the disease or condition is cancer (eg, a solid tumour), an autoimmune disease or condition; or an inflammatory disease or condition.

In an example, the cancer is selected from the group consisting of breast cancer, lung cancer (eg, non-small cell lung cancer), colon cancer, ovarian cancer, melanoma (eg, stage IV melanoma), bladder cancer, liver cancer (eg, hepatocellular carcinoma), kidney cancer, salivary gland cancer, stomach cancer, gastric cancer, glioma, pancreas cancer, thyroid cancer, thymic epithelial cancer, head cancer and/or neck cancer, multiple myeloma, T cell lymphoma, Hodgkin lymphoma, renal cell carcinoma, cervical cancer, colorectal, a haematological neoplasm, metastatic colorectal cancer, uterine or cervix cancer, a leukaemia (eg, acute myelogenous leukaemia), diffuse large B-cell lymphoma, follicle centre lymphoma, prostate cancer and Merkel cell carcinoma.

Alternatively, the disease or condition is a viral infection, eg, HIV, hepatitis C or Ebola infection. Alternatively, the disease or condition is melodysplastic syndrome.

In an example, the condition is a cancer, eg, metastatic cancer.

6. The method of any one of aspects 1 to 5, comprising, before said administering, selecting a human comprising said PD-L1 nucleotide sequence, wherein the human is the human of aspect 1.

7. The method of any one of aspects 1 to 6, wherein the human has been determined to comprise said PD-L1 nucleotide sequence.

8. The method of any one of aspects 1 to 6, comprising the step of determining that the human comprises said PD-L1 nucleotide sequence, optionally, wherein the determining step is performed before administration of the antibody to the human.

9. The method of aspect 8, wherein the step of determining comprises assaying a biological sample from the human for a PD-L1 nucleotide sequence comprising said selected variation.

10. The method of aspect 9, wherein the assaying comprises contacting the biological sample with
   a. at least one oligonucleotide probe comprising a sequence of at least 10 contiguous nucleotides that can specifically hybridize to and identify in the biological sample a nucleotide sequence comprising said selected variation or that specifically hybridizes to an antisense of said sequence, wherein said nucleic acid hybridizes to said selected variation or hybridizes to an antisense sequence thereby forming a complex when at least one nucleotide sequence comprising said selected variation is present; and/or b. at least one oligonucleotide probe comprising a sequence of at least 10 contiguous nucleotides of a nucleotide sequence comprising said selected variation or comprising an antisense sequence of said contiguous nucleotides, wherein said sequence of contiguous nucleotides comprises said selected variation thereby forming a complex when the nucleotide sequence comprising said selected variation is present; and detecting the presence or absence of the complex, wherein detecting the presence of the complex determines that the human comprises a PD-L1 nucleotide sequence comprising said selected variation.

11. The method of aspect 10, wherein the assaying comprises nucleic acid amplification and optionally one or more methods selected from sequencing, next generation sequencing, nucleic acid hybridization, and allele-specific amplification and/or wherein the assaying is performed in a multiplex format.

12. The method of any one of aspects 1 to 11, wherein said human is or has been further determined to be substantially resistant a PD-L1 or PD-1 treatment.

13. The method of any one of aspects 1 to 11, wherein said human is receiving or has received a PD-L1 or PD-1 treatment or has reduced responsiveness to a PD-L1 or PD-1 treatment.

14. The method of aspect 9, wherein said biological sample comprises serum, blood, feces, tissue, a cell, urine and/or saliva of said human.

15. The method of any one of aspects 1 to 14, wherein said human has been diagnosed with a cancer, autoimmune disease or condition; or an inflammatory disease or condition.

16. The method of any one of aspects 1 to 15, wherein said ligand is administered by intravenous or subcutaneous injection and/or is comprised in an injectable preparation.

17. The method of any one of aspects 1 to 16, wherein the ligand is human.

18. An anti-human PD-L1 ligand (eg, an antibody, antibody fragment or human PD-L1 trap) for use in a method of any one of aspects 1 to 17.

19. The ligand of aspect 18, wherein the ligand is a human anti-human PD-L1 antibody (eg, durvalumab), antibody fragment or human PD-L1 trap.

20. The ligand of aspect 18 or 19, wherein said ligand is for intravenous or subcutaneous administration and/or is comprised in an injectable preparation.

For rs148170925, the 1000 Genomes Phase 1 database indicates a cumulative frequency across all human populations of 60% for the deletion (ie, presence on the SNP) and 40% for absence of the SNP (ie, presence of TG at chromosomal location 9:5454642-5454643). The following human populations have above average frequency for absence of the SNP: AMR (45%), EUR (54%), ASW (44%), CLM (42%), MXL (44%), PUR (49%), CEU (60%), FIN (57%), GBR (56%), IBS (46%) and TSI (46%); in an embodiment of the invention, the human is of any one of these ancestries. The following human populations have above average frequency for presence of the SNP: AFR (67%), ASN (76%), LWK (77%), YRI (65%), CHB (73%), CHS (79%), JPT (75%); in an embodiment of the invention, the human is of any one of these ancestries.

Example 7

TOIs For Cancer, Autoimmune & Inflammatory Applications

Example 7A

Tumour Targeting & Immuno-Oncology Applications

The tumour microenvironment is an important aspect of cancer biology that contributes to tumour initiation, tumour progression and responses to therapy. Cells and molecules of the immune system are a fundamental component of the tumour microenvironment. Importantly, therapeutic strategies can harness the immune system to specifically target tumour cells and this is particularly appealing owing to the possibility of inducing tumour-specific immunological memory, which might cause long-lasting regression and prevent relapse in cancer patients.

The composition and characteristics of the tumour microenvironment vary widely and are important in determining the anti-tumour immune response. For example, certain cells of the immune system, including natural killer cells, dendritic cells (DCs) and effector T cells, are capable of driving potent anti-tumour responses. However, tumour cells often induce an immunosuppressive microenvironment, which favours the development of immunosuppressive populations of immune cells, such as myeloid-derived suppressor cells and regulatory T cells. Understanding the complexity of immunomodulation by tumours is important for the development of immunotherapy. Various strategies are being developed to enhance anti-tumour immune responses, including DC-based vaccines and antagonists of inhibitory signalling pathways to overcome 'immune checkpoints'.

The invention provides methods involving administering an anti-TOI ligand to a human, the TOI being present in humans as a plurality of variants differing by one or more amino acid polymorphisms, the method comprising administering a ligand to the human, the ligand comprising first and second protein domains, wherein the first domain specifically binds a TOI variant comprising a first amino acid polymorphism, wherein the second domain comprises a second polymorphism, and wherein the human expresses (i) TOI comprising said first amino acid polymorphism; and (ii) protein domains comprising said second polymorphism.

Particularly, the invention provides a method of targeting a tumour in a human and, eg, in this case the TOI is a tumour antigen (eg, a tumour-specific antigen or a tumour-associated antigen, as will be clear to the skilled addressee). For example, the TOI is selected from the group consisting of human PD-L1, Alphafetoprotein (AFP), Carcinoembryonic antigen (CEA), CA-125, MUC-1, Epithelial tumor antigen (ETA) and Melanoma-associated antigen (MAGE).

Optionally the ligand comprises a human cytokine variant amino acid sequence, optionally the cytokine being selected from the group consisting of IL-2, IL-12, IL-15 and IL-21, eg, wherein the sequence is fused to the N-terminus of one or more heavy and/or light chains of the ligand when the ligand is an antibody or fragment or a trap comprising Fc regions.

In an example, the cytokine is human IL-2 and the sequence comprises a polymorphism selected from 1421, 129D, 76L, 38L and 27T. For example, the sequence comprises 1421 and 129D. These positions are indicated to be polymorphic and associated with SNPs in Ensembl and dbSNP. In an embodiment, the ligand comprises an IL-2 amino acid sequence comprising one, more or all of the polymorphisms of said group. In an example, the cytokine comprises SEQ ID NO: 134.

In an example, the cytokine is human IL-21 and the sequence comprises a polymorphism selected from 32Q, 40R, 43I, 98V, 106K, 112A, 113G, 134K and 135E. For example, the sequence comprises 32Q and 40R. These positions are indicated to be polymorphic and associated with SNPs in Ensembl and dbSNP. In an embodiment, the ligand comprises an IL-21 amino acid sequence comprising one, more or all of the polymorphisms of said group.

In an alternative, there is provided a method of cancer immunotherapy and, eg, in this case the TOI is a human immune cell antigen (eg, wherein the antigen is a human natural killer cell, dendritic cell (DC) or effector T cell antigen). In another example the TOI is an immune checkpoint target.

In an embodiment the TOI is human PD-1. In an embodiment the TOI is human PD-L1 or PD-L2. In another embodiment the target is human CTLA-4. In another embodiment the target is human LAG-3. In another embodiment the target is human TIM-3. In an embodiment the TOI is human OX40 (and optionally the ligand agonises the TOI). In an embodiment the TOI is human KIR. In an embodiment the TOI is human CD137 (and optionally the ligand agonises the TOI). In an embodiment the TOI is human CD27 (and optionally the ligand agonises the TOI). In an embodiment the TOI is human CD70. In an embodiment the TOI is human B7-H3. In an embodiment the TOI is human KIR. In an embodiment the TOI is human GITR (and optionally the ligand agonises the TOI). In an example, the ligand comprises a human cytokine variant amino acid sequence as described above, the cytokine being useful for immunotherapy of cancer. Where an agonist is not mentioned, the ligand can for example antagonise the TOI.

In an example the ligand is selected from the ligands of Table 22.

TABLE 22

| Ligands |
|---|
| ipilimumab |
| nivolumab |
| pembrolizumab |
| durvalumab |
| tremelimumab |
| RG-7446 |
| lirilumab |
| MEDI-6469 |
| MSB-0010718C |
| pidilizumab |
| AMP-514 |
| TRX-518 |
| BMS-986016 |
| urelumab |
| varlilumab |
| PF-05082566 |
| SGN-CD70A |
| ARGX-110 |
| MGA-271 |
| rHIgM12B7 |

In an example of either alternative the method treats or reduces the risk of a cancer, eg, any cancer disclosed herein (eg, as disclosed in Example 5, 6 or this Example 7).

Thus, an alternative provides: A method of cancer immunotherapy in a human by targeting an immune cell TOI in the human, the TOI being present in humans as a plurality of variants differing by one or more amino acid polymorphisms, the method comprising administering a ligand to the human, the ligand comprising first and second protein domains, wherein the first domain specifically binds a TOI variant comprising a first amino acid polymorphism, wherein the second domain comprises a second polymorphism, and wherein the human expresses (i) TOI comprising said first amino acid polymorphism; and (ii) protein domains comprising said second polymorphism.

The TOI is for example PD-1 (also known as PDCD1, programmed cell death 1, PD1 and CD279), CTLA-4, LAG-3 or TIM-3. For example, the TOI is human PD-1 and the first polymorphism is a PD-1 polymorphism described herein (eg, a variation listed in Table 23). For example the polymorphism is encoded by a PD-1 SNP described herein.

It may be desirable to block (not necessarily clear as with an IgG1 format) the TOI in the method of this alternative and a human IgG4 may be preferable for doing this in a cancer immunotherapy setting. Thus, in an embodiment, the ligand comprises a human gamma-4 constant region, wherein the constant region comprises said second domain. Importantly, according to the invention, the constant region polymorphism is matched with the genome of the human, thereby minimising interfering immune responses, as may be desirable to minimise in the current cancer immunotherapy setting. "Blocking" of the TOI means, for example, antagonising the binding of the TOI to a cognate receptor or human biological target, eg, blocking PD-1 binding to PD-L1 and/or PD-L2; CTLA-4 binding to B7-1 or B7-2; or CD28 binding to B7-1 or B7-2.

For the cancer immunotherapy setting of the invention, it may be advantageous wherein the gamma-4 is a gamma-4 constant region with 228Pro or 235Glu. In an example the constant region is an IgG4PE (ie, a gamma-4 constant region with 228Pro and 235Glu). In an example, the ligand comprises human IGHG4*01 hinge S10>P constant region.

In an example, therefore, the ligand comprises any human gamma-4 constant region disclosed herein (eg, in any of Examples 1 et seq).

The present invention, thus, provides the following concepts:—
1. A method of cancer immunotherapy in a human by targeting an immune cell TOI (eg, PD-1) in the human, the TOI being present in humans as a plurality of variants differing by one or more amino acid polymorphisms, the method comprising administering a ligand (eg, an antibody or antibody fragment) to the human, the ligand comprising first and second protein domains, wherein the first domain specifically binds a TOI variant comprising a first amino acid polymorphism, wherein the second domain comprises a second polymorphism, and wherein the human expresses (i) TOI comprising said first amino acid polymorphism; and (ii) protein domains comprising said second polymorphism, wherein the ligand comprises a human gamma-4 heavy chain constant region that comprises a Leu at position 189 shown in SEQ ID NO: 73 or an Arg at position 289 shown in SEQ ID NO: 73 and wherein said human comprises an IGHG4*01 human heavy chain constant region gene segment, or the human expresses antibodies comprising human gamma-4 heavy chain constant regions comprising a Leu at position 189 shown in SEQ ID NO: 73 or an Arg at position 289 shown in SEQ ID NO: 73; and wherein the second domain is comprised by said gamma-4 heavy chain constant region of the ligand.

Optionally, the TOI is a human immune cell antigen (eg, wherein the antigen is a human natural killer cell, dendritic cell (DC) or effector T cell antigen).

The programmed death-1 (PD-1) receptor serves as an immunologic checkpoint, limiting bystander tissue damage and preventing the development of autoimmunity during inflammatory responses. PD-1 is expressed by activated T cells and down-modulates T-cell effector functions upon binding to its ligands, PD-L1 and PD-L2, on antigen-presenting cells. In patients with cancer, the expression of PD-1 on tumor-infiltrating lymphocytes and its interaction with the ligands on tumor and immune cells in the tumor microenvironment undermines antitumor immunity and supports the rationale for PD-1 blockade in cancer immunotherapy. In a particularly preferred embodiment, there is provided a method of cancer immunotherapy in a human by targeting PD-1 in the human.

2. The method of concept 1, wherein the first and/or second polymorphism is respectively encoded by a SNP having a cumulative human allele frequency of less than 50%.

Optionally the frequency is less than 45, 40, 35, 30, 25, 20, 15, 10, 5, 4, 3, 2, or 1%.

3. The method of any preceding concept, wherein the first domain is an antibody variable domain or a receptor domain.
4. The method of any preceding concept, wherein the second domain is an antibody domain, optionally an antibody variable or constant domain.
5. The method of any preceding concept, wherein the second domain is a domain of an antibody Fc region.
6. The method of any one of concepts 1 to 4, wherein the first and second domains are antibody variable domains, optionally wherein the variable domains specifically bind first and second human TOI respectively, wherein the TOIs are different.
7. The method of any one of concepts 1 to 4, wherein the first and second domains are receptor domains, optionally wherein the receptor domains specifically bind first and second human TOI respectively, wherein the TOIs are different.
8. The method of concept 6 or 7, wherein the first domain comprises a third amino acid polymorphism, wherein the human expresses (iii) domains comprising said third amino acid polymorphism.

Optionally the human expresses the second TOI variant. In an example, the second TO is a human immune cell surface antigen or a tumour antigen.

Optionally the third polymorphism is encoded by a SNP having a cumulative human frequency of less than 50%. Optionally the frequency is less than 45, 40, 35, 30, 25, 20, 15, 10, 5, 4, 3, 2, or 1%.

In an example, the first domain is an antibody variable domain (eg, any V domain of the invention described herein, such human VH3-23*04 as herein described) and the domains of (iii) are antibody variable domains. For example, the first domains and domains of (iii) are VH domains. For example, the first domains and domains of (iii) are Vκ domains. For example, the first domains and domains of (iii) are Vλ domains.

In an example, the first domain is a receptor binding site and the domains of (iii) are said receptor binding site domains.

9. A method according to concepts 1, 2 and 8 combined.
10. The method of any one of concepts 1 to 3, wherein the second domain is a domain of a human cytokine variant, optionally selected from the group consisting of IL-2, IL-12, IL-15 and IL-21, and the domains of (ii) are domains of said cytokine variant.

In an example, the second domain is a domain of human IL-2 and the second polymorphism is selected from the group consisting of 142I, 129D, 76L, 38L and 27T. For example, the second domain comprises 142I and 129D. These positions are indicated to be polymorphic and associated with SNPs in Ensembl and dbSNP. In an embodiment, the ligand comprises an IL-2 amino acid sequence comprising one, more or all of the polymorphisms of said group.

In an example, the second domain is a domain of human IL-21 and the second polymorphism is selected from the group consisting of 32Q, 40R, 43I, 98V, 106K, 112A, 113G, 134K and 135E. For example, the second domain comprises 32Q and 40R. These positions are indicated to be polymorphic and associated with SNPs in Ensembl and dbSNP. In an embodiment, the ligand comprises an IL-21 amino acid sequence comprising one, more or all of the polymorphisms of said group.

11. The method of any preceding concept, wherein the human expresses the first and/or second domain.
12. The method of any preceding concept, wherein the first, second and/or third polymorphism is respectively found in at least 5 different human populations as defined in Table 4.

For example, each of the first and second polymorphisms is respectively found in at least 5 different human populations as defined in Table 4. For example, each of the first, second and polymorphisms is respectively found in at least 5 different human populations as defined in Table 4.

Optionally the first, second and/or third (see below) polymorphism respectively appears in at least 9, 10, 11, 12, 13, 14, 15, 16, 17, 18, 19 or 20 different human populations as defined in Table 4.

13. The method of concept 12, wherein the first, second and/or third polymorphism respectively appears in at least 15 humans in the 1000 Genomes Phase I database.

In an embodiment, the first, second and/or third polymorphism is found in at least 20, 25, 30, 35, 40, 45, 50, 55, 60, 65, 70, 75, 80, 85, 90, 95, 100, 105, 110, 115, 120, 130, 140 or 150 human individuals distributed across such many different human populations.

14. The method of any preceding concept, wherein the first, second and/or third polymorphism is respectively found in at least 5 different human populations as defined in Table 4 and is encoded by a SNP having a cumulative human allele frequency of less than 50%.

Optionally the frequency is less than 45, 40, 35, 30, 25, 20, 15, 10, 5, 4, 3, 2, or 1%.

15. The method of any preceding concept, wherein the first, second and/or third polymorphism is respectively encoded by a SNP having total human genotype frequency of less than 50%.

Optionally the frequency is less than 45, 40, 35, 30, 25, 20, 15, 10, 5, 4, 3, 2, or 1%.

16. The method of any preceding concept, wherein the first and second domains are human, optionally wherein the ligand is fully human.
17. The method of any preceding concept, wherein the ligand is an anti-TOI trap, antibody or antibody fragment.
18. The method of any preceding concept, wherein the ligand specifically binds two or more human TOIs, eg, said first and second TOIs.
19. The method of any preceding concept, wherein the ligand is administered to the human by injection or the ligand is provided by an injectable preparation.
20. The method of any preceding concept, wherein said human has been or is genotyped as positive for said TOI variant nucleotide sequence before administering the ligand, or the method comprises genotyping the human as positive for said variant nucleotide sequence before administering the ligand.

21. The method of any preceding concept, wherein the human has been or is phenotyped as positive for said TOI variant before administering the ligand, or the method comprises phenotyping the human as positive for said variant before administering the ligand.

22. The method of any preceding concept, comprising, before said administering, selecting a human comprising said first TOI polymorphism, wherein the human is the human of concept 1.

23. The method of any preceding concept, wherein the human has been determined to comprise the first and/or second TOI variant or a nucleotide sequence encoding the TOI variant(s).

24. The method of any preceding concept, comprising the step of determining that the human comprises a first TOI nucleotide sequence encoding the first polymorphism, optionally, wherein the determining step is performed before administration of the ligand to the human.

25. The method of concept 24 wherein the step of determining comprises assaying a biological sample from the human for said nucleotide sequence.

26. The method of concept 25, wherein the assaying comprises contacting the biological sample with
   a. a. at least one oligonucleotide probe comprising a sequence of at least 10 contiguous nucleotides that can specifically hybridize to and identify in the biological sample a nucleotide sequence comprising a SNP encoding the first polymorphism or that specifically hybridizes to an antisense of said sequence, wherein said nucleic acid hybridizes to said SNP or hybridizes to an antisense sequence thereby forming a complex when at least one nucleotide sequence comprising said SNP is present; and/or
   b. b. at least one oligonucleotide probe comprising a sequence of at least 10 contiguous nucleotides of a nucleotide sequence comprising said SNP or comprising an antisense sequence of said contiguous nucleotides, wherein said sequence of contiguous nucleotides comprises said SNP thereby forming a complex when the nucleotide sequence comprising said SNP is present; and
   c. detecting the presence or absence of the complex, wherein detecting the presence of the complex determines that the human comprises the first TOI nucleotide sequence.

27. The method of concept 25, wherein the assaying comprises nucleic acid amplification and optionally one or more methods selected from sequencing, next generation sequencing, nucleic acid hybridization, and allele-specific amplification and/or wherein the assaying is performed in a multiplex format.

28. The method of any preceding concept, wherein said human is or has been further determined to be substantially resistant to a cancer treatment.

29. The method of any preceding concept, wherein said human is receiving or has received cancer treatment or has reduced responsiveness to a cancer treatment.

30. The method of concept 25, wherein said biological sample comprises serum, blood, feces, tissue, a cell, urine and/or saliva of said human.

31. The method of any preceding concept, wherein said human has been diagnosed with said disease or condition.

32. An anti-TOI ligand (eg, an antibody, antibody fragment or trap) for use in the method of any preceding concept. For example, the TOI is human PD-1 (eg, the ligand is is pembrolizumab, lambrolizumab or KEYTRUDA™. In an example, the ligand is nivolumab or OPDIVO™) For example, the TOI is human CTLA-4, eg, the ligand is ipilimumab, YERVOY™ tremelimumab, ticilimumab, belatacept or Nulojix™.

In an embodiment, the trap is a receptor Fc fusion (ie, a receptor domain fused to an antibody Fc region, eg, as a dimer), wherein the receptor specifically binds to the TOI.

33. The ligand of concept 32, wherein the ligand is fully human.

34. The ligand of concept 32 or 33, wherein the ligand is for administration by injection or the ligand is provided by an injectable preparation; wherein the ligand is for topical or inhaled administration or the ligand is provided by a topical or inhalable preparation.

In an example, the first, second and/or third polymorphism respectively:—
   d. has a cumulative human allele frequency of 15% or less;
   e. has a total human genotype frequency of 20% or less;
   f. is found in at least 5 different human populations (using the standard categorisation of the 1000 Genomes Project, eg, as per the Phase I database); and
   g. is found in many individuals distributed across such many different populations.

In an example, the criteria are applied with reference to one or more human genomic sequence databases as described herein. For example, the criteria are those as applied to the 1000 Genomes database.

For example in any aspect example, embodiment or configuration of the invention, the 1000 Genomes database release 13 or Phase I. For example, the 1000 Genomes database in its most recent version as at 1 Oct. 2013 or 1 Oct. 2014.

In an example, the human is homozygous for the first polymorphism. Additionally or alternatively, the human is homozygous for the first polymorphism. Additionally or alternatively, the human is homozygous for the third polymorphism. For example, the human is homozygous for the first and second polymorphisms.

In an example, the method is according to any one of the disclosure herein involving selecting, genotyping or phenotyping the human as positive for the TOI variant (ie, in the present case human PD-1 comprising the polymorphism or a nucleotide sequence encoding this). In an example, the method is according to any one of concepts above involving the determining step or wherein the human has been determined to comprise the variant TOI variant (eg, in the present case human PD-1 comprising the polymorphism or a nucleotide sequence encoding this).

In an example, the first polymorphism is a human PD-1 amino acid polymorphism described herein or is encoded by a human PD-1 SNP described herein.

In an example, wherein the TOI is human PD-1 the first polymorphism is encoded by a SNP selected from the group consisting of rs7568402, rs28699177, rs28542728, rs118117097, rs28570544, rs118027315, rs191919871, rs6707556 and rs142909968.

The invention further provides the following specific aspects:—

1. A method of cancer immunotherapy in a human by targeting PD-1 in the human, the method comprising administering an antibody or antibody fragment to the human, wherein the antibody or antibody fragment specifically binds a PD-1 comprising a first amino acid polymorphism, wherein the antibody or antibody fragment comprises a human gamma-4 heavy chain constant region that comprises a Leu at position 189 shown in SEQ ID NO: 73 or an Arg at position 289 shown in SEQ ID NO: 73 and wherein said human comprises (i) an IGHG4*01 human heavy chain constant region gene segment, or the human expresses antibodies comprising human gamma-4 heavy chain constant regions comprising a Leu at position 189 shown in SEQ ID NO: 73 or an Arg at position 289 shown in SEQ ID NO: 73; and (ii) a PD-1 nucleotide sequence encoding a PD-1 comprising said first amino acid polymorphism or the human expresses a PD-1 comprising said first amino acid polymorphism.

A first alternative aspect 1 provides:—

A method of cancer immunotherapy in a human by targeting PD-1 in the human, the method comprising administering an antibody or antibody fragment to the human, wherein the antibody or antibody fragment specifically binds a PD-1 encoded by a PD-1 nucleotide sequence comprising a SNP (first polymorphism) selected from the group consisting of the variations set out in Table 23 (eg, selected from the group consisting of rs36084323, rs10204225, rs11568821, rs2227981 and rs2227982), wherein the antibody or antibody fragment comprises a human gamma-4 heavy chain constant region that comprises a Leu at position 189 shown in SEQ ID NO: 73 or an Arg at position 289 shown in SEQ ID NO: 73 and wherein said human comprises (i) an IGHG4*01 human heavy chain constant region gene segment, or the human expresses antibodies comprising human gamma-4 heavy chain constant regions comprising a Leu at position 189 shown in SEQ ID NO: 73 or an Arg at position 289 shown in SEQ ID NO: 73; and (ii) a PD-1 nucleotide sequence comprising said selected SNP.

These SNPs are discussed further below.

A first alternative aspect 1 provides:—

A method of treating cancer in a human, the method comprising administering an antibody or antibody fragment to the human, wherein the antibody or antibody fragment inhibits the binding of PD-L1 or PD-L2 to a PD-1 comprising a first amino acid polymorphism, wherein the antibody or antibody fragment comprises a human gamma-4 heavy chain constant region that comprises a Leu at position 189 shown in SEQ ID NO: 73 or an Arg at position 289 shown in SEQ ID NO: 73 and wherein said human comprises (i) an IGHG4*01 human heavy chain constant region gene segment, or the human expresses antibodies comprising human gamma-4 heavy chain constant regions comprising a Leu at position 189 shown in SEQ ID NO: 73 or an Arg at position 289 shown in SEQ ID NO: 73; and (ii) a PD-1 nucleotide sequence encoding a PD-1 comprising said first amino acid polymorphism or the human expresses a PD-1 comprising said first amino acid polymorphism. In an example, the human comprises a PD-1 nucleotide sequence comprising a SNP selected from the group consisting of a PD-L1 SNP disclosed in Example 6, or PD-1 SNP rs36084323, rs10204225, rs11568821, rs2227981 and rs2227982; optionally wherein the human has been determined to comprise said SNP or the method comprises determining that the human comprises said SNP before administering the antibody or fragment.

In an example the antibody or fragment specifically binds human PD-L1, PD-L2 or PD-1. In an example the antibody or fragment specifically binds human PD-L1. In an example the antibody or fragment specifically binds human PD-1.

For example, the PD-L1 comprises a PD-L1 polymorphism described in Example 6 or is encoded by a PD-L1 nucleotide sequence comprising a PD-L1 SNP described in Example 6.

For example, the PD-1 comprises a PD-1 polymorphism described herein (eg, in Table 23) or is encoded by a PD-1 nucleotide sequence comprising a PD-1 SNP described herein (eg, in Table 23), eg, a SNP selected from the group consisting of rs36084323, rs10204225, rs11568821, rs2227981 and rs2227982. These SNPs are discussed further below.

2. The method of aspect 1, wherein the first polymorphism or selected SNP is a nucleotide corresponding to SNP rs36084323, rs10204225, rs11568821, rs2227981 or rs2227982.

3. The method of aspect 1 or 2, wherein said human is homozygous for said first polymorphism or selected SNP.

4. The method of any preceding aspect, wherein the ligand comprises an IGHG4*01 human heavy chain constant region.

5. The method of any preceding aspect, wherein the cancer is selected from the group consisting of renal cell carcinoma; haematological neoplasm; stage IV melanoma; non small-cell lung cancer; metastatic stomach cancer; breast cancer; solid tumour; bladder cancer; head and neck cancer, colorectal cancer, glioblastoma, gastric cancer, non-Hodgkin's lymphoma, Hodgkin's lymphoma, follicular lymphoma, cervical cancer, myeloid leukaemia (eg, acute myeloid leukaemia or chronic myeloid leukaemia). In an embodiment, the cancer is not melanoma. In an embodiment, the cancer is not lung cancer. In an embodiment, the cancer is not non small-cell lung cancer.

6. The method of any preceding aspect, comprising, before said administering, selecting a human comprising said PD-1 nucleotide sequence of (ii), wherein the human is the human of aspect 1.

7. The method of any preceding aspect, wherein the human has been determined to comprise said PD-L nucleotide sequence of (ii).

8. The method of any preceding aspect, comprising the step of determining that the human comprises said PD-L nucleotide sequence of (ii), optionally, wherein the determining step is performed before administration of the antibody to the human.

9. The method of aspect 8, wherein the step of determining comprises assaying a biological sample from the human for a PD-L nucleotide sequence comprising said selected variation.

10. The method of aspect 9, wherein the assaying comprises contacting the biological sample with
   a. a. at least one oligonucleotide probe comprising a sequence of at least 10 contiguous nucleotides that can specifically hybridize to and identify in the biological sample a nucleotide sequence comprising said selected variation or that specifically hybridizes to an antisense of said sequence, wherein said nucleic acid hybridizes to said selected variation or hybridizes to an antisense sequence thereby forming a complex when at least one nucleotide sequence comprising said selected variation is present; and/or
   b. b. at least one oligonucleotide probe comprising a sequence of at least 10 contiguous nucleotides of a nucleotide sequence comprising said selected variation or comprising an antisense sequence of said contiguous nucleotides, wherein said sequence of contiguous nucleotides comprises said selected variation thereby forming a complex when the nucleotide sequence comprising said selected variation is present; and
   c. detecting the presence or absence of the complex, wherein detecting the presence of the complex determines that the human comprises a PD-L1 nucleotide sequence comprising said selected variation.
11. The method of aspect 10, wherein the assaying comprises nucleic acid amplification and optionally one or more methods selected from sequencing, next generation sequencing, nucleic acid hybridization, and allele-specific amplification and/or wherein the assaying is performed in a multiplex format.
12. The method of any preceding aspect, wherein said human is or has been further determined to be substantially resistant a cancer, PD-L1 or PD-1 treatment.

For example the human is or has been further determined to be resistant to a chemotherapy treatment.

13. The method of any preceding aspect, wherein said human is receiving or has received a cancer (eg, chemotherapy), PD-L1 or PD-1 treatment or has reduced responsiveness to a cancer (eg, chemotherapy), PD-L1 or PD-1 treatment.
14. The method of aspect 9, wherein said biological sample comprises serum, blood, feces, tissue, a cell, urine and/or saliva of said human.
15. The method of any preceding aspect, wherein said ligand is administered by intravenous or subcutaneous injection and/or is comprised in an injectable preparation.
16. The method of any preceding aspect, wherein the ligand is human, eg, a human antibody or antibody fragment.
17. An anti-human PD-1 ligand (eg, an antibody, antibody fragment or trap) for use in the method of any preceding aspect.

For example, the ligand is is pembrolizumab, lambrolizumab or KEYTRUDA™. In an example, the ligand is nivolumab or OPDIVO™).

In an embodiment, the trap is a receptor Fc fusion (ie, a receptor domain fused to an antibody Fc region, eg, as a dimer), wherein the receptor specifically binds to human PD-1.

18. The ligand of aspect 17, wherein the ligand is fully human.
19. The ligand of aspect 17 or 18, wherein the ligand is for administration by injection or the ligand is provided by an injectable preparation; wherein the ligand is for topical or inhaled administration or the ligand is provided by a topical or inhalable preparation.

Optionally in any of the configurations, concepts, aspects, embodiments or examples, one or more of the following optional features applies.

Optionally, the cancer is selected from the group consisting of renal cell carcinoma; haematological neoplasm; stage IV melanoma; non small-cell lung cancer; metastatic stomach cancer; breast cancer; solid tumour; bladder cancer; head and neck cancer, colorectal cancer, glioblastoma, gastric cancer, non-Hodgkin's lymphoma, Hodgkin's lymphoma, follicular lymphoma, cervical cancer, myeloid leukaemia (eg, acute myeloid leukaemia or chronic myeloid leukaemia). In an embodiment, the cancer is not melanoma. In an embodiment, the cancer is not lung cancer. In an embodiment, the cancer is not non small-cell lung cancer.

Optionally, the cancer is renal cell cancer.

Optionally, the cancer is locally advanced or metastatic carcinoma, locally advanced or metastatic melanoma, or locally advanced or metastatic non-small cell lung carcinoma.

Optionally, the cancer is urothelial cancer.

Optionally, the cancer is recurrent or metastatic head and neck squamous cell carcinoma.

Optionally, the cancer is PD-L1-positive advanced or metastatic non-small cell lung cancer.

Optionally, the cancer is multiple myeloma.

Optionally, the cancer is advanced melanoma.

Optionally, the cancer is advanced Merkel cell cancer.

Optionally, the cancer is solid tumour, eg, advanced solid tumours.

In an example, the ligand comprises a human IgG4PE constant region.

In an example, the ligand is pembrolizumab, lambrolizumab or KEYTRUDA™. In an example, the ligand is nivolumab or OPDIVO™.

The TOI polymorphism is associated, for example, with a cancer, such as any cancer disclosed herein.

The invention also provides an anti-TOI ligand (eg, a human PD-1, PD-L1 or PD-L2 trap, or anti-human PD-1, PD-L1 or PD-L2 antibody or fragment) for use in any cancer treatment or immunotherapy method of the invention.

Optionally, the ligand (eg, an antibody or antibody fragment) is according to one of the following options:—

(i) wherein the ligand comprises a VH domain derived from the recombination of a human VH segment (eg, human VH3-23*04), a human D gene segment and a human JH segment, the human VH segment encoding the framework 1 of SEQ ID NO: 40 and wherein said human comprises a VH gene segment encoding the framework 1 of SEQ ID NO: 40, or the human expresses VH domains that comprise the framework 1 of SEQ ID NO: 40.

(ii) wherein the ligand comprises a VH domain derived from the recombination of human VH segment selected from the group consisting of IGHV3-33*01 and IGHV3-7*01, a human D gene segment and a human JH segment, and wherein said human comprises said selected VH gene segment or the human expresses VH domains derived from the recombination of said selected human VH segment, a human D gene segment and a human JH segment.

(iii) wherein the ligand comprises a Vκ domain derived from the recombination of human Vκ segment selected from the group consisting of IGKV3-11*01 and IGKV1-12*01 and a human Jκ segment, and wherein said human comprises said selected Vκ gene segment or the human expresses Vκ domains derived from the recombination of said selected human Vκ segment and a human Jκ segment.

(iv) wherein the ligand comprises a Vκ domain derived from the recombination of a human Vκ segment and a human Jκ segment, the human Vκ segment encoding (i) a CDR3 comprising a Pro at position 7 shown in SEQ ID NO: 36 and wherein said human comprises a Vκ gene segment encoding a CDR3 comprising a Pro at position 7 shown in SEQ ID NO: 36, or the human expresses Vκ domains that comprise a CDR3 comprising a Pro at position 7 shown in SEQ ID NO: 36; or (ii) a FW3 comprising a Ser at position 15 shown in SEQ ID NO: 38 and wherein said human comprises a Vκ gene segment encoding a FW3 comprising a Ser at position 15 shown in SEQ ID NO: 38 or the human expresses Vκ domains that comprise a FW3 comprising a Ser at position 15 shown in SEQ ID NO: 38.

Optionally, instead of a gamma-4 constant region, the ligand (eg, a trap, antibody or fragment) comprises a heavy chain constant region according to any of the following options:—

(v) wherein the ligand comprises a human gamma-1 heavy chain constant region that comprises an Asp at position 204 shown in SEQ ID NO: 4 or a Leu at position 206 shown in SEQ ID NO: 4 and wherein said human comprises (i) an IGHG1*01 human heavy chain constant region gene segment, or the human expresses antibodies comprising human gamma-1 heavy chain constant regions comprising an Asp at position 204 shown in SEQ ID NO: 4 or a Leu at position 206 shown in SEQ ID NO: 4.

(vi) wherein the ligand comprises a human gamma-2 heavy chain constant region that comprises an amino acid selected from the group consisting of a Pro at position 72 shown in SEQ ID NO: 6, an Asn at position 75 shown in SEQ ID NO: 6, a Phe at position 76 shown in SEQ ID NO: 6, a Val at position 161 shown in SEQ ID NO: 6 and an Ala at position 257 shown in SEQ ID NO: 6 and wherein said human comprises (i) an IGHG2*01 human heavy chain constant region gene segment, or the human expresses antibodies comprising human gamma-2 heavy chain constant regions comprising said selected Pro at position 72 shown in SEQ ID NO: 6, Asn at position 75 shown in SEQ ID NO: 6, Phe at position 76 shown in SEQ ID NO: 6, Val at position 161 shown in SEQ ID NO: 6 or Ala at position 257 shown in SEQ ID NO: 6. In an example, the constant region is Fc enhanced, eg, ADCC or CDC enhanced. The skilled person will know techniques (eg, known C region mutations) to enhance ADCC or CDC.

(vii) wherein the ligand comprises a human gamma-3 heavy chain constant region encoded by a first human IGHG3 (eg, IGHG3*01) constant region gene segment and wherein said human comprises (i) said first constant region gene segment (eg, an IGHG3*01), or the human expresses antibodies comprising human gamma-3 heavy chain constant regions encoded by said first human IGHG3 (eg, IGHG3*01) constant region gene segment.

Optionally, the ligand (eg, an antibody or antibody fragment) is according to one of the following options:—

(viii) wherein the ligand comprises a human kappa chain constant region that comprises a Val at position 84 shown in SEQ ID NO: 16 or a Cys at position 87 shown in SEQ ID NO: 16 and wherein said human comprises (i) an IGKC1*01 human kappa chain constant region gene segment, or the human expresses antibodies comprising human kappa chain constant regions comprising a Val corresponding to position 84 shown in SEQ ID NO: 16 or a Cys at position 87 shown in SEQ ID NO: 16.

(ix) wherein the ligand comprises a human IGLC1*01 lambda chain constant region and wherein said human comprises (i) a human IGLC1*01 lambda chain constant region gene segment, or the human expresses antibodies comprising human IGLC1*01 lambda chain constant regions.

(x) wherein the ligand comprises a human epsilon heavy chain constant region encoded by a first human epsilon heavy chain constant region gene segment and wherein said human comprises (i) said first constant region gene segment, or the human expresses antibodies comprising human epsilon heavy chain constant regions encoded by said first constant region gene segment.

(xii) wherein the ligand comprises a human mu heavy chain constant region encoded by a first human mu heavy chain constant region gene segment and wherein said human comprises (i) said first constant region gene segment, or the human expresses antibodies comprising human mu heavy chain constant regions encoded by said first constant region gene segment.

(xiii) wherein the ligand comprises a human alpha heavy chain constant region encoded by a first human alpha heavy chain constant region gene segment and wherein said human comprises (i) said first constant region gene segment, or the human expresses antibodies comprising human alpha heavy chain constant regions encoded by said first constant region gene segment.

(xiv) wherein the ligand comprises a human delta heavy chain constant region encoded by a first human delta heavy chain constant region gene segment and wherein said human comprises (i) said first constant region gene segment, or the human expresses antibodies comprising human delta heavy chain constant regions encoded by said first constant region gene segment.

(xv) wherein the ligand comprises a human kappa light chain constant region encoded by a first human kappa light chain constant region gene segment and wherein said human comprises (i) said first constant region gene segment, or the human expresses antibodies comprising human kappa light chain constant regions encoded by said first constant region gene segment.

(xvi) wherein the ligand comprises a human lambda light chain constant region encoded by a first human lambda light chain constant region gene segment and wherein said human comprises (i) said first constant region gene segment, or the human expresses antibodies comprising human lambda light chain constant regions encoded by said first constant region gene segment.

REFERENCES (a) Cancer Immunol Res. 2014 September; 2(9):846-56. doi: 10.1158/2326-6066.CIR-14-0040. Epub 2014 May 28; "In vitro characterization of the anti-PD-1 antibody nivolumab, BMS-936558, and in vivo toxicology in non-human primates", Wang C et al.

(b) Clin Biochem. 2014 May; 47(7-8):612-7. doi: 10.1016/j.clinbiochem.2013.12.023. Epub 2014 Jan. 2; "Programmed death-1 (PD-1) polymorphisms in Chinese patients with esophageal cancer"; Qiu H et al.

(c) Gene. 2012 Oct. 25; 508(2):229-32. doi: 10.1016/j.gene.2012.07.059. Epub 2012 Aug. 8; "Programmed death-1 gene polymorphism (PD-1.5 C/T) is associated with colon cancer"; Mojtahedi Z et al.

(d) Gastroenterol Hepatol Bed Bench. 2013 Fall; 6(4):178-82; "Programmed death-1 gene polymorphism (PD-1.5 C/T) is associated with gastric cancer"; Savabkar S et al.

(e) Breast Cancer Res Treat. 2011 August; 129(1):195-201. doi: 10.1007/s10549-011-1440-3. Epub 2011 Apr. 13; "PD-1 polymorphisms are associated with sporadic breast cancer in Chinese Han population of Northeast China"; Hua Z et al.

Human Polymorphisms & SNPs

The inventor carried out assessment of natural human variation in PD-1 and identified the following variations of interest for application to the present invention.

TABLE 23

Human PD-1 Variation

| SNP/ VARIANT | CHROMOSOMAL LOCATION (FORWARD STRAND) | NUCLEOTIDE CHANGE[1] | AMINO ACID CHANGE[2] | AMINO ACID POSITIONS[3] | CUMULATIVE FREQUENCY[4] |
|---|---|---|---|---|---|
| rs7568402 | | | | | |
| rs28699177 | | | | | |
| rs28542728 | | | | | |
| rs118117097 | | | | | |
| rs28570544 | | | | | |
| rs118027315 | | | | | |
| rs191919871 | | | | | |
| rs6707556 | | | | | |
| rs142909968 | | | | | |
| rs36084323[+] | 2:241859444 | C > T | | | 0.17 |
| rs10204225 | 2:197610964 | G > A | | | |
| rs11568821[++] | 2:241851760 | C > T | | | 0.05 |

TABLE 23-continued

Human PD-1 Variation

| SNP/ VARIANT | CHROMO- SOMAL LOCATION (FORWARD STRAND) | NUCLE- OTIDE CHANGE[1] | AMINO ACID CHANGE[2] | AMINO ACID POSI- TIONS[3] | CUMU- LATIVE FRE- QUEN- CY[4] |
|---|---|---|---|---|---|
| rs2227981[+++] | 2:241851121 | G > A | | | 0.38 |
| rs2227982[++++] | 2:241851281 | G > A | A215V | 215 | 0.160 |

[1, 2, 3, 4] According to Ensembl, dbSNP; with reference to transcript ENST00000334409 (the sequence of this transcript being incorporated herein in its entirety).
[+]rs36084323 is present in humans at an average cumulative frequency of 17% according to the 1000 Genomes Phase I database, but is higher in AMR, ASN, MXL, CHB, CHS and JPT populations; thus in an embodiment, the human is of ASN ancestry, eg, of MXL, CHB, CHS or JPT ancestry.
[++]rs11568821 is present in humans at an average cumulative frequency of 5% according to the 1000 Genomes Phase I database, but is higher in AMR, EUR, PUR, CEU, GBR, IBS and TSI populations; thus in an embodiment, the human is of AMR or EUR ancestry, eg, of CEU, GBR, IBS or TSI ancestry.
[+++]rs2227981 is present in humans at an average cumulative frequency of 38% according to the 1000 Genomes Phase I database, but is higher in AFR, EUR, ASW, LWK, YRI, CEU, GBR, IBS and TSI populations; thus in an embodiment, the human is of AFR or EUR ancestry, eg, of ASW, LWK, YRI, CEU, GBR, IBS or TSI ancestry.
[++++]rs2227982 is present in humans at an average cumulative frequency of 16% according to the 1000 Genomes Phase I database, but is higher in ASN, CHB, CHS and JPT populations; thus in an embodiment, the human is of ASN ancestry, eg, of CHB, CHS or JPT ancestry.

Using this analysis, the inventor has devised the configurations, aspects, concepts, examples and embodiments of the invention set out in this Example 7 that are useful for addressing diseases and conditions, such as cancer, autoimmune or inflammatory diseases and conditions.

In an embodiment, the human comprises a SNP selected from the SNPs in column 1 of Table 23; optionally also the ligand specifically binds a PD-1 encoded by a nucleotide sequence comprising said SNP.

In an embodiment, the ligand (eg, trap, antibody or antibody fragment) specifically binds a PD-1 comprising a corresponding variation as shown in Table 23 or is encoded by a nucleotide sequence comprising or encoding a SNP or amino acid variation shown in Table 23.

For example the SNP is selected from rs36084323, rs10204225, rs11568821, rs2227981 and rs2227982. For example the SNP is rs36084323. For example the SNP is rs10204225. For example the SNP is rs11568821. For example the SNP is rs2227981. For example the SNP is rs2227982.

In an example the SNP and indication are a SNP/indication combination mentioned in any of the references disclosed in this Example 7.

In an example, the indication is aplastic anaemia and the SNP is a G at the position of rs36084323.

Example 7B

Autoimmune, Inflammatory & Other Disease Applications

In an alternative, instead of "A method of cancer immunotherapy" or "A method of treating cancer", the invention as expressed in Example 7A can instead be read as "A method of treating or reducing the risk of an autoimmune disease or condition" or "A method of treating or reducing the risk inflammatory disease or condition" and the TOI polymorphism is associated with an autoimmune or inflammatory disease or condition. The other non-cancer features of this example apply mutatis mutandis to these alternatives. The TOI (eg, PD-1) comprises said first polymorphism or is encoded by a nucleotide sequence comprising said selected SNP.

For example, the autoimmune disease or condition is selected from the group consisting of rheumatoid arthritis, diabetes (eg, type I diabetes mellitus), Grave's disease, multiple sclerosis and systemic lupus erythematosus.

For example, the inflammatory disease or condition is selected from the group consisting of rheumatoid arthritis, ankylosing spondylitis, psoriasis, asthma, colitis and atopic dermatitis. For example, the method is for treating or reducing the risk of ankylosing spondylitis. In an example, the human is of Chinese (eg, CHS) ancestry.

REFERENCES (a) Vibanco-Perez N, Gutierrez-Franco J, Duran-Avelar M, Agraz-Cibrian J, Jimenez-Alvarez M, Peña-Virgen S and Zambrano-Zaragoza J (2013). Association of PD1.1 and PD1.6 polymorphisms with ankylosing spondylitis. *Front. Immunol. Conference Abstract: 15th International Congress of Immunology (ICI).* doi: 10.3389/conf.fimmu.2013.02.0079. Various SNPs in the PD1 gene have been identified, such as PD1.1 (rs36084323), PD1.3 (rs11568821), PD1.5 (rs2227981), and PD1.9 (rs2227982). Among these, PD1.3, PD1.5, and PD1.9 have been associated with autoimmune disorders in different human populations. PD1.1 and PD1.6 are two single nucleotide polymorphisms, at −600 G/A (rs36084323), and +8669 G/A (rs10204225) respectively, that have been associated with others autoimmune diseases such as rheumatoid arthritis, type I diabetes mellitus, and systemic lupus erythematosus.

(b) Rheumatol Int. 2011 February; 31(2):209-13. doi: 10.1007/s00296-009-1264-1. Epub 2009 Dec. 12; "Programmed cell death 1 gene polymorphisms is associated with ankylosing spondylitis in Chinese Han population"; Liu X et al.
The genotype distributions of PD-1.9 were reportedly significantly different between the patients with ankylosing spondylitis and the controls (P=0.025). The frequencies of TC genotype and T allele of PD-1.9 were higher in the patients than those in the controls (P=0.026 and 0.004). Moreover, the frequency of the CT haplotype (PD-1.5 C/T, PD-1.9 T/C) was significantly higher in AS patients than the controls (21.6 vs. 13.9%, P=0.002). The CC haplotype was more common in the controls than in the patients.

(c) Tissue Antigens. 2003 December; 62(6):492-7; "Association of a putative regulatory polymorphism in the PD-1 gene with susceptibility to type 1 diabetes", Nielsen C et al.
Human PD-1 intronic 7146G/A SNP was found to be associated with the development of type 1 diabetes in humans.

(d) Inflammation. 2011 December; 34(6):707-12. doi: 10.1007/s10753-010-9282-4; "Study of programmed cell death 1 (PDCD1) gene polymorphims in Iranian patients with ankylosing spondylitis", Soleimanifar N et al.

(e) Clin Exp Rheumatol. 2011 January-February; 29(1):13-8. Epub 2011 Feb. 23; "Association of polymorphisms in the programmed cell death 1 (PD-1) and PD-1 ligand genes with ankylosing spondylitis in a Chinese population"; Yang Q et al.

(f) Arthritis Rheum. 2005 June; 52(6):1665-9; "Association of a PDCD1 polymorphism with renal manifestations in systemic lupus erythematosus"; Johansson M et al.

(g) Arthritis Rheum. 2005 April; 52(4):1058-62; "A new haplotype of PDCD1 is associated with rheumatoid arthritis in Hong Kong Chinese"; Kong E K et al.

(h) Ann Neurol. 2005 July; 58(1):50-7; "A PD-1 polymorphism is associated with disease progression in multiple sclerosis"; Kroner A et al.

(i) Leuk Lymphoma. 2013 October; 54(10):2251-4. doi: 10.3109/10428194.2013.772605. Epub 2013 Mar. 4;

"Association between polymorphisms in PDCD1 gene and aplastic anemia in Chinese Han population; Wu Z et al.

Example 8

Iron Regulation

The existence of multiple inherited disorders of iron metabolism suggests genetic contributions to iron deficiency. To this end, the inventor assessed naturally-occurring variation in human proteins of the iron homeostasis pathway, and for example the hemojuvelin-BMP6-hepcidin-ferroportin axis.

BMP6 is also known as bone morphogenetic protein 6, BMP-6, VGR-1, VG-1-R, VG-1-related protein, Vgl-related sequence, vegetal-related (TGFB related) cytokine and vegetal related growth factor (TGFB-related).

Matriptase-2 (also known as TMPRSS6) is a critical regulator of the iron-regulatory hormone hepcidin in the liver; matriptase-2 cleaves membrane-bound hemojuvelin and consequently alters bone morphogenetic protein (BMP) signaling. Hemojuvelin and hepcidin play a critical role in retinal iron homeostasis; they are also expressed in the retina.

The invention provides methods of iron homeostasis involving administering anti-TOI ligand to a human, the TOI being present in humans as a plurality of variants differing by one or more amino acid polymorphisms, the method comprising administering a ligand to the human, the ligand comprising first and second protein domains, wherein the first domain specifically binds a TOI variant comprising a first amino acid polymorphism, wherein the second domain comprises a second polymorphism, and wherein the human expresses (i) TOI comprising said first amino acid polymorphism; and (ii) protein domains comprising said second polymorphism. Particularly useful are methods wherein the TOI is selected from the human hemojuvelin-BMP6-TMPRSS6-hepcidin-ferroportin-transferrin axis.

A: Indications & Humans

Optionally the method is a method for increasing or maintaining increased blood iron, eg, for treating or reducing the risk of anaemia; or treating iron deficiency; or for treating or reducing the risk of Anaemia of Chronic Inflammation (ACI); or for treating or reducing the risk of Anaemia of Chronic Disease (ACD); or for treating or reducing the risk of anaemia associated with cancer, a kidney condition or GvHD; or for treating or reducing the risk of hemochromatosis.

In an embodiment, the patient is a haemodialysis patient and optionally TOI is selected from the human hemojuvelin-BMP6-TMPRSS6-hepcidin-ferroportin-transferrin axis (eg, the TOI is TMPRSS6 that comprises the A736V polymorphism; or eg, the human comprises the A736V polymorphism).

In an embodiment, the patient is a coronary heart disease patient. In an embodiment, the human is suffering from an inflammatory disease or condition, eg, an acute acute inflammation.

In an embodiment, the method is for treating or reducing the risk of haemochromatosis.

In an embodiment, the method is for reducing or maintaining reduced hepcidin level in the human.

In an embodiment, the method is for regulating (eg, increasing; eg, decreasing) erythropoiesis in the human and optionally TOI is selected from the human hemojuvelin-BMP6-TMPRSS6-hepcidin-ferroportin-transferrin axis (eg, the TOI is TMPRSS6 that comprises the A736V polymorphism; or eg, the human comprises the A736V polymorphism).

In an embodiment, the method is for treating or reducing the risk of iron overload in the human.

In an embodiment, the method is for treating or reducing the risk of iron-refractory iron deficiency anaemia (IRIDA) in the human.

B: Human Polymorphisms & SNPs

Any feature of this section B is combinable with any feature of section A above. For example, the human and/or TOI comprises a SNP as described below and the method or ligand of the invention is according to one or more features of A, comprising administering an anti-TOI ligand.

The inventor carried out assessment of natural human variation in genes and proteins involved in iron homeostasis in humans and identified the following variations of interest for application to the present invention.

TABLE 24

Iron Homeostasis - Human Polymorphism & SNPs

| SNP/VARIANT | CHROMOSOMAL LOCATION (FORWARD STRAND) | NUCLEOTIDE CHANGE[1] | AMINO ACID CHANGE[2] | AMINO ACID POSITIONS[3] | CUMULATIVE FREQUENCY[4] |
|---|---|---|---|---|---|
| | | BMP6[5] | | | |
| rs111588693* | 6:7727038 | G > A | R28Q | 28 | 0.338 |
| | | TRANSFERRIN | | | |
| rs3811647** | 3:133765185 | G > A | | | 0.34 |
| | | TMPRSS[6] | | | |
| | | | Y141C | | |
| | | | I212T | | |
| | | | R271Q | | |
| | | | S304L | | |
| | | | C510S | | |
| rs855791*** | 22:37066896 | A > G | A736V | 736 | 0.398 |
| rs1421312**** | 22:37091770 | A > G | | | |
| rs2543519 | 22:37084229 | A > G | I430T | | 0.245 |
| rs2235324 | 22:37089684 | T > C | K244W | 244 | 0.393 |
| | | HFE[7] | | | |
| rs1799945 | 6:26090951 | C > G | H63D | 63 | 0.084 |
| rs1800562 | 6:26092913 | G > A | C282Y | 282 | 0.020 |

TABLE 24-continued

Iron Homeostasis - Human Polymorphism & SNPs

| SNP/VARIANT | CHROMOSOMAL LOCATION (FORWARD STRAND) | NUCLEOTIDE CHANGE[1] | AMINO ACID CHANGE[2] | AMINO ACID POSITIONS[3] | CUMULATIVE FREQUENCY[4] |
|---|---|---|---|---|---|
| CUBN[8] | | | | | |
| rs10904850# | 10:16955708 | G > A | | | 0.21 |
| rs1801224 | 10:17105522 | T > G | P389T | 389 | 0.440 |
| FERROPORTIN[9] | | | | | |
| rs11568350## | 2:189565370 | C > A | Q248H | 248 | 0.010 |
| HAEMOJUVELIN[10] | | | | | |
| rs7540883### | 1:146018429 | C > G | A310G | 310 | 0.022 |
| HEPCIDIN[11] | | | | | |
| rs146776859 | 19:35284790 | C > T | T31M | 31 | 0.002 |
| MISCELLANEOUS | | | | | |
| rs987710 | 22:22158022 | G > A | | | 0.38 |
| rs2698530 | 2:64276761 | A > C | | | 0.33 |

[1,2,3,4] According to Ensembl, dbSNP;
[5] with reference to transcript ENST00000283147 (the sequence of this transcript being incorporated herein in its entirety).
[6] with reference to transcript ENST00000346753 (the sequence of this transcript being incorporated herein in its entirety); with the exception of rs2543519, which is with reference to transcript ENST00000442782 (the sequence of this transcript being incorporated herein in its entirety);
[7] with reference to transcript ENST00000309234 (the sequence of this transcript being incorporated herein in its entirety);
[8] with reference to transcript ENST00000377833 (the sequence of this transcript being incorporated herein in its entirety);
[9] with reference to transcript ENST00000261024 (the sequence of this transcript being incorporated herein in its entirety);
[10] with reference to transcript ENST00000336751 (the sequence of this transcript being incorporated herein in its entirety);
[11] with reference to transcript ENST00000222304 (the sequence of this transcript being incorporated herein in its entirety);

*rs111588693 is present in humans at an average cumulative frequency of 34% according to the 1000 Genomes Phase I database, but is higher in EUR, CEU, FIN, GBR, IBS and TSI populations; thus in an embodiment, wherein the method involves BMP6, eg administering an anti-BMP6 ligand, the human is of EUR ancestry, eg, of CEU, FIN, GBR, IBS or TSI ancestry.
**rs3811647 is present in humans at an average cumulative frequency of 34% according to the 1000 Genomes Phase I database, but is higher in ASN, CHB, CHS and JPT populations; thus in an embodiment, wherein the method involves transferrin, eg administering an anti-transferrin ligand, the human is of ASN ancestry, eg, of CHB, CHS or JPT ancestry.
***rs855791 is present in humans at an average cumulative frequency of 40% according to the 1000 Genomes Phase I database, but is higher in AMR, ASN, CLM, MXL, PUR, CHB, CHS and JPT populations; thus in an embodiment, wherein the method involves TMPRSS6, eg administering an anti-TMPRSS6 ligand, the human is of AMR or ASN ancestry, eg, of CLM, MXL, PUR, CHB, CHS or JPT ancestry.
****rs1421312 is present in humans at an average cumulative frequency of 44% according to the 1000 Genomes Phase I database, but is higher in AFR, ASW, LWK and YRI populations; thus in an embodiment, wherein the method involves TMPRSS6, eg administering an anti-TMPRSS6 ligand, the human is of AFR ancestry, eg, of ASW, LWK or YRI ancestry.
rs10904850 is present in humans at an average cumulative frequency of 21% according to the 1000 Genomes Phase I database, but is higher in EUR, CEU, FIN, GBR, IBS and TSI populations; thus in an embodiment, wherein the method involves CUBN, eg administering an anti-CUBN ligand, the human is of EUR ancestry, eg, of CEU, FIN, GBR, IBS or TSI ancestry.
rs11568350 is present in humans at an average cumulative frequency of 1% according to the 1000 Genomes Phase I database, but is higher in AFR, ASW, LWK and YRI populations; thus in an embodiment, wherein the method involves ferroportin, eg administering an anti-ferroportin ligand (eg, antibody), the human is of AFR ancestry, eg, of , ASW, LWK or YRI ancestry.
rs7540883 is present in humans at an average cumulative frequency of 2% according to the 1000 Genomes Phase I database, but is higher in AFR, ASW, LWK and YRI populations; thus in an embodiment, wherein the method involves haemojuvelin, eg administering an anti-haemojuvelin ligand (eg, antibody or trap, such as human HJV-Fc dimer), the human is of AFR ancestry, eg, of, ASW, LWK or YRI ancestry.

SNP rs111588693 encodes an amino acid in the region of the cleavage site for the proprotein of BM6, and thus it may be desirable to target a BMP6 encoded by a nucleotide sequence comprising rs111588693 in the human, optionally wherein the human comprises a BMP6 nucleotide sequence comprising said SNP.

In an embodiment, the human comprises a SNP selected from the SNPs in column 1 of Table 24; optionally also the ligand specifically binds a protein (eg, a TOI of said human hemojuvelin-BMP6-TMPRSS6-hepcidin-ferroportin-transferrin axis) encoded by a nucleotide sequence comprising said SNP.

In an embodiment, the ligand (eg, trap, antibody or antibody fragment) specifically binds a TOI protein (eg, a TOI of said human hemojuvelin-BMP6-TMPRSS6-hepcidin-ferroportin-transferrin axis) comprising a corresponding variation as shown in Table 24 or is encoded by a nucleotide sequence comprising or encoding a SNP or amino acid variation shown in Table 24.

For example, the TOI is a protein of the human hemojuvelin-BMP6-TMPRSS6-hepcidin-ferroportin-transferrin axis. In an example, the TOI is human hemojuvelin. In an example, the TOI is human BMP6 (and optionally comprising amino acid 28Q or encoded by a BMP6 nucleotide sequence comprising SNP rs111588693; in an embodiment the human expresses BMP6 that comprises said variation). In an example, the TOI is human hepcidin. In an example, the TOI is human ferroportin. In an example, the TOI is human transferrin (and optionally encoded by a transferrin nucleotide sequence comprising SNP rs3811647; in an embodiment the human expresses transferrin that comprises said variation). In an example, the TOI is human TMPRSS6 (and optionally comprises one or more variations selected from the group consisting of A736V, Y141C, 1212T, R271Q, S304L and C510S; or is encoded by a TMPRSS6 nucleotide sequence comprising SNP rs855791 or rs1421312 or encoding one or more variations selected from said group; in an embodiment the human expresses TMPRSS6 that comprises said variation). For example, the TMPRSS6 comprises variation A736V and optionally the human expresses TMPRSS6 that comprises variation A736V. In an example, the TOI is human erythroferrone. In an example, the TOI is human hemochromatosis protein, HFE (and optionally comprising amino acid 282Y or encoded by a HFE nucleotide sequence comprising SNP rs1800562; in an embodiment the human expresses HFE that comprises said variation). In an example, the TOI is the product of the human CUBN nucleotide sequence or the human comprises a CUBN nucleotide sequence, the nucleotide sequence comprising SNP rs10904850; in an embodiment the human expresses CUBN protein that comprises said variation. CUBN is also known as cubilin and intrinsic factor-cobalamin receptor. Ferroportin is also known as solute carrier family 40 member 1 (SLC40A1) or iron-regulated transporter 1. Haemojuvelin is also known as hemojuvelin, HFE2A, HJV, JH and RGMC.

In an example, the human comprises SNP rs2698530 on chr. 2p14 and/or rs987710 on chr. 22q11.

It may be desirable to block (not necessarily clear as with an IgG1 format) the TOI in the method of this alternative and a human IgG4 may be preferable for doing this in an iron regulation setting. Thus, in an embodiment, the ligand comprises a human gamma-4 constant region. For the iron regulation setting of the invention, it may be advantageous wherein the gamma-4 is a gamma-4 constant region with 228Pro or 235Glu. In an example the constant region is an IgG4PE (ie, a gamma-4 constant region with 228Pro and 235Glu). In an example, the ligand comprises human IGHG4*01 hinge S10>P constant region.

In an example, therefore, the ligand comprises any human gamma-4 constant region disclosed herein (eg, in any of Examples 1 et seq).

REFERENCES (a) Nutr Hosp. 2012 November-December; 27(6):2142-5. doi: 10.3305/nh.2012.27.6.6154; "Intronic SNP rs3811647 of the human transferrin gene modulates its expression in hepatoma cells"; Blanco-Rojo R et al.
Transferrin (Tf) exerts a crucial function in the maintenance of systemic iron homeostasis. The expression of the Tf gene is controlled by transcriptional mechanism. The authors conclude that A allele of SNP rs3811647 increases Tf expression in a manner that might underlie inter-individual variation in serum transferrin levels observed in different population groups.
(b) J Med Genet. 2013 September; 50(9):593-8. doi: 10.1136/jmedgenet-2013-101673. Epub 2013 Jun. 21; "Associations of common variants in HFE and TMPRSS6 with iron parameters are independent of serum hepcidin in a general population: a replication study"; Galesloot T E et al.
The authors found that HFE rs1800562 and TMPRSS6 rs855791 are the main determinants of HFE and TMPRSS6 related variation in serum iron, ferritin, transferrin saturation, and total iron binding capacity.
(c) BMC Nephrol. 2013 Feb. 22; 14:48. doi: 10.1186/1471-2369-14-48; "The A736V TMPRSS6 polymorphism influences hepcidin and iron metabolism in chronic hemodialysis patients: TMPRSS6 and hepcidin in hemodialysis"; Pelusi S et al.
The A736V TMPRSS6 polymorphism is a major genetic determinant of iron metabolism in healthy subjects. The authors reported the TMPRSS6 736 V variant was associated with higher hepcidin levels (p=0.017). In patients without acute inflammation and overt iron deficiency (C reactive protein <1 mg/dl and ferritin >30 ng/ml; n=86), hepcidin was associated with lower mean corpuscular volume (p=0.002), suggesting that it contributed to iron-restricted erythropoiesis. In line with previous results, in patients without acute inflammation and severe iron deficiency the "high hepcidin" 736 V TMPRSS6 variant was associated with higher erythropoietin maintenance dose (p=0.016), independently of subclinical inflammation (p=0.02).

(d) PLoS One. 2012; 7(6):e38339. doi: 10.1371/journal.pone.0038339. Epub 2012 Jun. 22; "Associations between single nucleotide polymorphisms in iron-related genes and iron status in multiethnic populations"; McLaren C E et al.
Three chromosomal regions showed association across multiple populations, including SNPs in the TF and TMPRSS6 genes, and on chromosome 18q21. A novel SNP rs1421312 in TMPRSS6 was associated with serum iron in whites (p=3.7×10(−6)) and replicated in African Americans (p=0.0012). Twenty SNPs in the TF gene region were associated with total iron-binding capacity in whites (p<4.4×10(−5)); six SNPs replicated in other ethnicities (p<0.01). SNP rs10904850 in the CUBN gene on 10p13 was associated with serum iron in African Americans (P=1.0×10(−5)).
(e) PLoS One. 2011 Mar. 31; 6(3):e17390. doi: 10.1371/journal.pone.0017390; "Genome-wide association study identifies genetic loci associated with iron deficiency"; McLaren C E et al. Five SNPs were identified in a Genome-Wide Association Study that met genome-wide statistical significance for association with at least one iron measure, rs2698530 on chr. 2p14; rs3811647 on chr. 3q22, a known SNP in the transferrin (TF) gene region; rs1800562 on chr. 6p22, the C282Y mutation in the HFE gene; rs7787204 on chr. 7p21; and rs987710 on chr. 22q11 (GWAS observed P<1.51×10(−7) for all). An association was observed between total iron binding capacity and SNP rs3811647 in the TF gene (GWAS observed P=7.0×10(−9). The analysis revealed strong associations between rs2698530 on chr. 2p14 and iron status outcomes.
(f) Hum Mutat. 2010 May; 31(5):E1390-405. doi: 10.1002/humu.21243; "Novel TMPRSS6 mutations associated with iron-refractory iron deficiency anemia (IRIDA)"; De Falco L et al. Mutations leading to abrogation of matriptase-2 proteolytic activity in humans are associated with an iron-refractory iron deficiency anemia (IRIDA) due to elevated hepcidin levels. The authors describe 12 IRIDA patients belonging to 7 unrelated families and identify 10 (9 novel) TMPRSS6 mutations spread along the gene sequence: 5 missense, 1 non sense and 4 frameshift. The frameshift and non sense mutations are predict to result in truncated protein lacking the catalytic domain. The causal role of missense mutations (Y141C, 1212T, R271Q, 5304L and C510S) is demonstrated by in silico analysis, their absence in 100 control chromosomes and the high conservation of the involved residues. The C510S mutation in the LDLRA domain in silico model causes an intra-molecular structural imbalance that impairs matriptase-2 activation. We also assessed the in vitro effect on hepcidin promoter and the proteolytic activity of I212T and R271Q variants demonstrating a reduced inhibitory effect for the former mutation, but surprisingly a normal function for R271Q which appears a silent mutation in vitro. Based on mRNA expression studies 1212T could also decrease the total amount of protein produced, likely interfering with mRNA stability. Collectively, our results extend the pattern of TMPRSS6 mutations associated with IRIDA and propose a model of causality for some of the novel missense mutation.

The invention provides the following concepts:—
1. A method of treating or reducing the risk of a disease or condition in a human, wherein the disease or condition is mediated by a TOI, the TOI being present in humans as a plurality of variants differing by one or more amino acid polymorphisms, the method comprising administering a ligand (eg, an antibody or antibody fragment) to the human, the ligand comprising first and second protein domains, wherein the first domain specifically binds a TOI variant comprising a first amino acid polymorphism, wherein the second domain comprises a second polymorphism, and wherein the human expresses (i) TOI comprising said first amino acid polymorphism; and (ii) protein domains comprising said second polymorphism, optionally wherein the ligand comprises a human gamma-4 heavy chain constant region that comprises a Leu at position 189 shown in SEQ ID NO: 73 or an Arg at position 289 shown in SEQ ID NO: 73 and wherein said human comprises an IGHG4*01 human heavy chain constant region gene segment, or the human expresses antibodies comprising human gamma-4 heavy chain constant regions comprising a Leu at position 189 shown in SEQ ID NO: 73 or an Arg at position 289 shown in SEQ ID NO: 73; and wherein the second domain is comprised by said gamma-4 heavy chain constant region of the ligand.

Optionally, the TOI is selected from the human hemojuvelin-BMP6-TMPRSS6-hepcidin-ferroportin-transferrin axis. In an example, the TOI is human hemojuvelin. In an example, the TOI is human BMP6. In an example, the TOI is human TMPRSS6. In an example, the TOI is human hepcidin. In an example, the TOI is human ferroportin. In an example, the TOI is human HFE. In an example, the TOI is human transferrin. A TOI of "the human hemojuvelin-BMP6-TMPRS56-hepcidin-ferroportin-transferrin axis" is a human protein (eg, expressed by liver) that is part of the iron regulation pathway comprising hemojuvelin, BMP6, TMPRSS6, hepcidin, ferroportin and transferrin.

For example, the method can be for any of the purposes or indications set out section A. In an example, the method is for regulating iron in the human. In an example, the iron is blood iron or circulating iron or free iron.

In an example, the method is a method of reducing anaemia in the human.

2. The method of concept 1, wherein the first and/or second polymorphism is respectively encoded by a SNP having a cumulative human allele frequency of less than 50%.

Optionally the frequency is less than 45, 40, 35, 30, 25, 20, 15, 10, 5, 4, 3, 2, or 1%.

3. The method of any preceding concept, wherein the first domain is an antibody variable domain or a receptor domain.
4. The method of any preceding concept, wherein the second domain is an antibody domain, optionally an antibody variable or constant domain.
5. The method of any preceding concept, wherein the second domain is a domain of an antibody Fc region.
6. The method of any one of concepts 1 to 4, wherein the first and second domains are antibody variable domains, optionally wherein the variable domains specifically bind first and second human TOI respectively, wherein the TOIs are different.

Optionally, the second TOI is selected from the human hemojuvelin-BMP6-TMPRSS6-hepcidin-ferroportin-transferrin axis. In an example, the second TOI is human hemojuvelin. In an example, the second TOI is human BMP6. In an example, the second TOI is human TMPRSS6. In an example, the second TOI is human hepcidin. In an example, the second TOI is human ferroportin. In an example, the second TOI is human HFE. In an example, the second TOI is human transferrin.

7. The method of any one of concepts 1 to 4, wherein the first and second domains are receptor domains, optionally wherein the receptor domains specifically bind first and second human TOI respectively, wherein the TOIs are different.
8. The method of concept 6 or 7, wherein the first domain comprises a third amino acid polymorphism, wherein the human expresses (iii) domains comprising said third amino acid polymorphism.

Optionally the human expresses the second TOI variant.

Optionally the third polymorphism is encoded by a SNP having a cumulative human frequency of less than 50%. Optionally the frequency is less than 45, 40, 35, 30, 25, 20, 15, 10, 5, 4, 3, 2, or 1%.

In an example, the first domain is an antibody variable domain (eg, any V domain of the invention described herein, such human VH3-23*04 as herein described) and the domains of (iii) are antibody variable domains. For example, the first domains and domains of (iii) are VH domains. For example, the first domains and domains of (iii) are Vκ domains. For example, the first domains and domains of (iii) are Vλ domains.

In an example, the first domain is a receptor binding site and the domains of (iii) are said receptor binding site domains.

9. A method according to concepts 1, 2 and 8 combined.
10. The method of any preceding concept, wherein the human expresses the first and/or second domain.
11. The method of any preceding concept, wherein the first, second and/or third polymorphism is respectively found in at least 5 different human populations as defined in Table 4.

For example, each of the first and second polymorphisms is respectively found in at least 5 different human populations as defined in Table 4. For example, each of the first, second and polymorphisms is respectively found in at least 5 different human populations as defined in Table 4.

Optionally the first, second and/or third (see below) polymorphism respectively appears in at least 9, 10, 11, 12, 13, 14, 15, 16, 17, 18, 19 or 20 different human populations as defined in Table 4.

12. The method of concept 11, wherein the first, second and/or third polymorphism respectively appears in at least 15 humans in the 1000 Genomes Phase I database.

In an embodiment, the first, second and/or third polymorphism is found in at least 20, 25, 30, 35, 40, 45, 50, 55, 60, 65, 70, 75, 80, 85, 90, 95, 100, 105, 110, 115, 120, 130, 140 or 150 human individuals distributed across such many different human populations.

13. The method of any preceding concept, wherein the first, second and/or third polymorphism is respectively found in at least 5 different human populations as defined in Table 4 and is encoded by a SNP having a cumulative human allele frequency of less than 50%.

Optionally the frequency is less than 45, 40, 35, 30, 25, 20, 15, 10, 5, 4, 3, 2, or 1%.

14. The method of any preceding concept, wherein the first, second and/or third polymorphism is respectively encoded by a SNP having total human genotype frequency of less than 50%.

Optionally the frequency is less than 45, 40, 35, 30, 25, 20, 15, 10, 5, 4, 3, 2, or 1%.

15. The method of any preceding concept, wherein the first and second domains are human, optionally wherein the ligand is fully human.
16. The method of any preceding concept, wherein the ligand is an anti-TOI trap, antibody or antibody fragment.
17. The method of any preceding concept, wherein the ligand specifically binds two or more human TOIs, eg, said first and second TOIs.

18. The method of any preceding concept, wherein the ligand is administered to the human by injection or the ligand is provided by an injectable preparation.
19. The method of any preceding concept, wherein said human has been or is genotyped as positive for said TOI variant nucleotide sequence before administering the ligand, or the method comprises genotyping the human as positive for said variant nucleotide sequence before administering the ligand.
20. The method of any preceding concept, wherein the human has been or is phenotyped as positive for said TOI variant before administering the ligand, or the method comprises phenotyping the human as positive for said variant before administering the ligand.
21. The method of any preceding concept, comprising, before said administering, selecting a human comprising said first TOI polymorphism, wherein the human is the human of concept 1.
22. The method of any preceding concept, wherein the human has been determined to comprise the first and/or second TOI variant or a nucleotide sequence encoding the TOI variant(s).
23. The method of any preceding concept, comprising the step of determining that the human comprises a first TOI nucleotide sequence encoding the first polymorphism, optionally, wherein the determining step is performed before administration of the ligand to the human.
24. The method of concept 23 wherein the step of determining comprises assaying a biological sample from the human for said nucleotide sequence.
25. The method of concept 24, wherein the assaying comprises contacting the biological sample with
    h. a. at least one oligonucleotide probe comprising a sequence of at least 10 contiguous nucleotides that can specifically hybridize to and identify in the biological sample a nucleotide sequence comprising a SNP encoding the first polymorphism or that specifically hybridizes to an antisense of said sequence, wherein said nucleic acid hybridizes to said SNP or hybridizes to an antisense sequence thereby forming a complex when at least one nucleotide sequence comprising said SNP is present; and/or
    i. b. at least one oligonucleotide probe comprising a sequence of at least 10 contiguous nucleotides of a nucleotide sequence comprising said SNP or comprising an antisense sequence of said contiguous nucleotides, wherein said sequence of contiguous nucleotides comprises said SNP thereby forming a complex when the nucleotide sequence comprising said SNP is present; and
    j. detecting the presence or absence of the complex, wherein detecting the presence of the complex determines that the human comprises the first TOI nucleotide sequence.
26. The method of concept 24, wherein the assaying comprises nucleic acid amplification and optionally one or more methods selected from sequencing, next generation sequencing, nucleic acid hybridization, and allele-specific amplification and/or wherein the assaying is performed in a multiplex format.
27. The method of any preceding concept, wherein said human is or has been further determined to be substantially resistant to an anaemia treatment.
28. The method of any preceding concept, wherein said human is receiving or has received an anaemia treatment or has reduced responsiveness to an anaemia treatment.
29. The method of concept 25, wherein said biological sample comprises serum, blood, feces, tissue, a cell, urine and/or saliva of said human.
30. The method of any preceding concept, wherein said human has been diagnosed with said disease or condition.
31. An anti-TOI ligand (eg, an antibody, antibody fragment or trap) for use in the method of any preceding concept.

In an embodiment, the trap is a receptor Fc fusion (ie, a receptor domain fused to an antibody Fc region, eg, as a dimer), wherein the receptor specifically binds to the TOI.
32. The ligand of concept 31, wherein the ligand is fully human.
33. The ligand of concept 31 or 32, wherein the ligand is for administration by injection or the ligand is provided by an injectable preparation.

In an example, the first, second and/or third polymorphism respectively:—
    k. has a cumulative human allele frequency of 15% or less;
    l. has a total human genotype frequency of 20% or less;
    m. is found in at least 5 different human populations (using the standard categorisation of the 1000 Genomes Project, eg, as per the Phase I database); and
    n. is found in many individuals distributed across such many different populations.

In an example, the criteria are applied with reference to one or more human genomic sequence databases as described herein. For example, the criteria are those as applied to the 1000 Genomes database.

For example in any aspect example, embodiment or configuration of the invention, the 1000 Genomes database release 13 or Phase I. For example, the 1000 Genomes database in its most recent version as at 1 Oct. 2013.

In an example, the human is homozygous for the first polymorphism. Additionally or alternatively, the human is homozygous for the first polymorphism. Additionally or alternatively, the human is homozygous for the third polymorphism. For example, the human is homozygous for the first and second polymorphisms.

In an example, the method is according to any one of the disclosure herein involving selecting, genotyping or phenotyping the human as positive for the TOI variant (ie, in the present case human PD-1 comprising the polymorphism or a nucleotide sequence encoding this). In an example, the method is according to any one of concepts above involving the determining step or wherein the human has been determined to comprise the variant TOI variant (eg, in the present case human PD-1 comprising the polymorphism or a nucleotide sequence encoding this).

In an example, the first polymorphism is a human BMP6 amino acid polymorphism described herein or is encoded by a human BMP6 SNP described herein.

In an example, wherein the TOI is human BMP6 the first polymorphism is encoded by SNP rs111588693.

The invention further provides the following specific aspects:—
1. A method of treating or reducing the risk of anaemia in a human by targeting in the human a human TOI selected from the group consisting of BMP6, ferroportin, haemojuvelin, hepcidin and TMPRSS6, the method comprising administering an antibody or antibody fragment to the human, wherein the antibody or antibody fragment specifically binds a variant of said TOI comprising a first amino acid polymorphism, wherein the antibody or antibody fragment comprises a human gamma-4 heavy chain constant region that comprises a Leu at position 189 shown in SEQ ID NO: 73 or an Arg at position 289 shown in SEQ ID NO: 73 and wherein said human comprises (i) an IGHG4*01 human heavy chain constant region gene segment, or the human expresses antibodies comprising human gamma-4 heavy chain constant regions comprising a Leu at position 189 shown in SEQ ID NO: 73 or an Arg at position 289 shown in SEQ ID NO: 73; and (ii) a PD-1 nucleotide sequence encoding a PD-1 comprising said first amino acid polymorphism or the human expresses a PD-1 comprising said first amino acid polymorphism.

Preferably, the trap, antibody or fragment of any configuration, concept, aspect, example or embodiment comprises an IgG4PE constant region.

In an example of any configuration, concept, aspect, example or embodiment, an anti-TOI (eg, anti-BMP6) antibody is used.

A first aspect provides:—

A method of treating or reducing the risk of anaemia in a human, the method comprising administering an anti-BMP6 trap, antibody or antibody fragment to the human, wherein the trap, antibody or antibody fragment specifically binds a human BMP6 encoded by a BMP6 nucleotide sequence comprising a SNP rs111588693, wherein the trap, antibody or antibody fragment comprises a human gamma-4 heavy chain constant region that comprises a Leu at position 189 shown in SEQ ID NO: 73 or an Arg at position 289 shown in SEQ ID NO: 73 and wherein said human comprises (i) an IGHG4*01 human heavy chain constant region gene segment, or the human expresses antibodies comprising human gamma-4 heavy chain constant regions comprising a Leu at position 189 shown in SEQ ID NO: 73 or an Arg at position 289 shown in SEQ ID NO: 73; and (ii) a BMP6 nucleotide sequence comprising said SNP; optionally wherein the human has been determined to comprise said SNP or the method comprises determining that the human comprises said SNP before administering the antibody or fragment.

A second aspect provides:—

A method of treating or reducing the risk of anaemia in a human, the method comprising administering an anti-haemojuvelin trap, antibody or antibody fragment to the human, wherein the trap, antibody or antibody fragment specifically binds a human haemojuvelin encoded by a haemojuvelin nucleotide sequence comprising SNP rs7540883, wherein the trap, antibody or antibody fragment comprises a human gamma-4 heavy chain constant region that comprises a Leu at position 189 shown in SEQ ID NO: 73 or an Arg at position 289 shown in SEQ ID NO: 73 and wherein said human comprises (i) an IGHG4*01 human heavy chain constant region gene segment, or the human expresses antibodies comprising human gamma-4 heavy chain constant regions comprising a Leu at position 189 shown in SEQ ID NO: 73 or an Arg at position 289 shown in SEQ ID NO: 73; and (ii) a haemojuvelin nucleotide sequence comprising said SNP; optionally wherein the human has been determined to comprise said SNP or the method comprises determining that the human comprises said SNP before administering the antibody or fragment.

A third aspect provides:—

A method of treating or reducing the risk of anaemia in a human, the method comprising administering an anti-ferroportin trap, antibody or antibody fragment to the human, wherein the trap, antibody or antibody fragment specifically binds a human ferroportin encoded by a ferroportin nucleotide sequence comprising SNP rs11568350, wherein the trap, antibody or antibody fragment comprises a human gamma-4 heavy chain constant region that comprises a Leu at position 189 shown in SEQ ID NO: 73 or an Arg at position 289 shown in SEQ ID NO: 73 and wherein said human comprises (i) an IGHG4*01 human heavy chain constant region gene segment, or the human expresses antibodies comprising human gamma-4 heavy chain constant regions comprising a Leu at position 189 shown in SEQ ID NO: 73 or an Arg at position 289 shown in SEQ ID NO: 73; and (ii) a ferroportin nucleotide sequence comprising said SNP; optionally wherein the human has been determined to comprise said SNP or the method comprises determining that the human comprises said SNP before administering the antibody or fragment.

A fourth aspect provides:—

A method of treating or reducing the risk of anaemia in a human, the method comprising administering an anti-TMPRSS6 trap, antibody or antibody fragment to the human, wherein the trap, antibody or antibody fragment specifically binds a human TMPRSS6 encoded by a TMPRSS6 nucleotide sequence comprising a SNP selected from the group consisting of rs855791, rs1421312, rs2543519, rs2235324 wherein the trap, antibody or antibody fragment comprises a human gamma-4 heavy chain constant region that comprises a Leu at position 189 shown in SEQ ID NO: 73 or an Arg at position 289 shown in SEQ ID NO: 73 and wherein said human comprises (i) an IGHG4*01 human heavy chain constant region gene segment, or the human expresses antibodies comprising human gamma-4 heavy chain constant regions comprising a Leu at position 189 shown in SEQ ID NO: 73 or an Arg at position 289 shown in SEQ ID NO: 73; and (ii) a TMPRSS6 nucleotide sequence comprising said selected SNP; optionally wherein the human has been determined to comprise said SNP or the method comprises determining that the human comprises said SNP before administering the antibody or fragment.

A fifth aspect provides:—

A method of treating or reducing the risk of anaemia in a human, the method comprising administering an anti-hepcidin trap, antibody or antibody fragment to the human, wherein the trap, antibody or antibody fragment specifically binds a human hepcidin encoded by a hepcidin nucleotide sequence comprising SNP rs146776859, wherein the trap, antibody or antibody fragment comprises a human gamma-4 heavy chain constant region that comprises a Leu at position 189 shown in SEQ ID NO: 73 or an Arg at position 289 shown in SEQ ID NO: 73 and wherein said human comprises (i) an IGHG4*01 human heavy chain constant region gene segment, or the human expresses antibodies comprising human gamma-4 heavy chain constant regions comprising a Leu at position 189 shown in SEQ ID NO: 73 or an Arg at position 289 shown in SEQ ID NO: 73; and (ii) a hepcidin nucleotide sequence comprising said SNP; optionally wherein the human has been determined to comprise said SNP or the method comprises determining that the human comprises said SNP before administering the antibody or fragment.

2. The method of aspect 1, wherein the human is homozygous for said selected SNP.
3. The method of any preceding aspect, wherein the ligand comprises an IGHG4*01 human heavy chain constant region, eg, wherein the constant region is a gamma-4 constant region with 228Pro and/or 235Glu.
4. The method of any preceding aspect, wherein the anaemia is selected from the group consisting of Anaemia of Chronic Inflammation (ACI); Anaemia of Chronic Disease (ACD); or anaemia associated with cancer, a kidney condition or GvHD.
5. The method of any preceding aspect, comprising, before said administering, selecting a human comprising said BMP6, ferroportin, haemojuvelin, TMPRSS6 or hepcidin nucleotide sequence of (ii), wherein the human is the human of aspect 1.

6. The method of any preceding aspect, wherein the human has been determined to comprise said BMP6, ferroportin, haemojuvelin, TMPRSS6 or hepcidin nucleotide sequence of (ii).

7. The method of any preceding aspect, comprising the step of determining that the human comprises said BMP6, ferroportin, haemojuvelin, TMPRSS6 or hepcidin nucleotide sequence of (ii), optionally, wherein the determining step is performed before administration of the antibody to the human.

8. The method of aspect 7, wherein the step of determining comprises assaying a biological sample from the human for respectively a BMP6, ferroportin, haemojuvelin, TMPRSS6 or hepcidin nucleotide sequence comprising said selected variation.

9. The method of aspect 8, wherein the assaying comprises contacting the biological sample with
   a. a. at least one oligonucleotide probe comprising a sequence of at least 10 contiguous nucleotides that can specifically hybridize to and identify in the biological sample a nucleotide sequence comprising said selected variation or that specifically hybridizes to an antisense of said sequence, wherein said nucleic acid hybridizes to said selected SNP or hybridizes to an antisense sequence thereby forming a complex when at least one nucleotide sequence comprising said selected SNP is present; and/or
   b. b. at least one oligonucleotide probe comprising a sequence of at least 10 contiguous nucleotides of a nucleotide sequence comprising said selected SNP or comprising an antisense sequence of said contiguous nucleotides, wherein said sequence of contiguous nucleotides comprises said selected SNP thereby forming a complex when the nucleotide sequence comprising said selected SNP is present; and
   c. detecting the presence or absence of the complex, wherein detecting the presence of the complex determines that the human comprises respectively a BMP6, ferroportin, haemojuvelin, TMPRSS6 or hepcidin nucleotide sequence comprising said selected SNP.

10. The method of aspect 9, wherein the assaying comprises nucleic acid amplification and optionally one or more methods selected from sequencing, next generation sequencing, nucleic acid hybridization, and allele-specific amplification and/or wherein the assaying is performed in a multiplex format.

11. The method of any preceding aspect, wherein said human is or has been further determined to be substantially resistant an anaemia treatment (eg, EPO).

For example the human is or has been further determined to be resistant to an anaemia treatment (eg, EPO).

12. The method of any preceding aspect, wherein said human is receiving or has an anaemia treatment (eg, EPO) or has reduced responsiveness to an anaemia treatment (eg, EPO).

13. The method of aspect 8, wherein said biological sample comprises serum, blood, feces, tissue, a cell, urine and/or saliva of said human.

14. The method of any preceding aspect, wherein said trap, antibody or fragment is administered by intravenous or subcutaneous injection and/or is comprised in an injectable preparation.

15. The method of any preceding aspect, wherein the trap, antibody or fragment is human, eg, a human antibody or antibody fragment.

16. An anti-human TOI trap, antibody or antibody fragment for use in the method of any preceding aspect, wherein the TOI is selected from BMP6, ferroportin, haemojuvelin, TMPRSS6 and hepcidin.

In an embodiment, the trap is a haemojuvelin- or receptor-Fc fusion (ie, a receptor domain fused to an antibody Fc region, eg, as a dimer), wherein the receptor specifically binds to or competes with a TOI is selected from BMP6, ferroportin, haemojuvelin, TMPRSS6 and hepcidin.

17. The ligand of aspect 17, wherein the trap, antibody or antibody fragment is fully human.

18. The ligand of aspect 16 or 17, wherein the trap, antibody or antibody fragment is for administration by injection or the trap, antibody or antibody fragment is provided by an injectable preparation.

Optionally in any of the configurations, concepts, aspects, embodiments or examples, one or more of the following optional features applies.

Optionally, the ligand (eg, trap, antibody or antibody fragment) is according to one of the following options:—
(i) wherein the ligand comprises a VH domain derived from the recombination of a human VH segment (eg, human VH3-23*04), a human D gene segment and a human JH segment, the human VH segment encoding the framework 1 of SEQ ID NO: 40 and wherein said human comprises a VH gene segment encoding the framework 1 of SEQ ID NO: 40, or the human expresses VH domains that comprise the framework 1 of SEQ ID NO: 40.
(ii) wherein the ligand comprises a VH domain derived from the recombination of human VH segment selected from the group consisting of IGHV3-33*01 and IGHV3-7*01, a human D gene segment and a human JH segment, and wherein said human comprises said selected VH gene segment or the human expresses VH domains derived from the recombination of said selected human VH segment, a human D gene segment and a human JH segment.
(iii) wherein the ligand comprises a Vκ domain derived from the recombination of human Vκ segment selected from the group consisting of IGKV3-11*01 and IGKV1-12*01 and a human Jκ segment, and wherein said human comprises said selected Vκ gene segment or the human expresses Vκ domains derived from the recombination of said selected human Vκ segment and a human Jκ segment.
(iv) wherein the ligand comprises a Vκ domain derived from the recombination of a human Vκ segment and a human Jκ segment, the human Vκ segment encoding (i) a CDR3 comprising a Pro at position 7 shown in SEQ ID NO: 36 and wherein said human comprises a Vκ gene segment encoding a CDR3 comprising a Pro at position 7 shown in SEQ ID NO: 36, or the human expresses Vκ domains that comprise a CDR3 comprising a Pro at position 7 shown in SEQ ID NO: 36; or (ii) a FW3 comprising a Ser at position 15 shown in SEQ ID NO: 38 and wherein said human comprises a Vκ gene segment encoding a FW3 comprising a Ser at position 15 shown in SEQ ID NO: 38 or the human expresses Vκ domains that comprise a FW3 comprising a Ser at position 15 shown in SEQ ID NO: 38.

Optionally, instead of a gamma-4 constant region, the ligand (eg, a trap, antibody or fragment) comprises a heavy chain constant region according to any of the following options:—
(v) wherein the ligand comprises a human gamma-1 heavy chain constant region that comprises an Asp at position 204 shown in SEQ ID NO: 4 or a Leu at position 206 shown in SEQ ID NO: 4 and wherein said human comprises (i) an IGHG1*01 human heavy chain constant region gene segment, or the human expresses antibodies comprising human gamma-1 heavy chain constant regions comprising an Asp at position 204 shown in SEQ ID NO: 4 or a Leu at position 206 shown in SEQ ID NO: 4.

(vi) wherein the ligand comprises a human gamma-2 heavy chain constant region that comprises an amino acid selected from the group consisting of a Pro at position 72 shown in SEQ ID NO: 6, an Asn at position 75 shown in SEQ ID NO: 6, a Phe at position 76 shown in SEQ ID NO: 6, a Val at position 161 shown in SEQ ID NO: 6 and an Ala at position 257 shown in SEQ ID NO: 6 and wherein said human comprises (i) an IGHG2*01 human heavy chain constant region gene segment, or the human expresses antibodies comprising human gamma-2 heavy chain constant regions comprising said selected Pro at position 72 shown in SEQ ID NO: 6, Asn at position 75 shown in SEQ ID NO: 6, Phe at position 76 shown in SEQ ID NO: 6, Val at position 161 shown in SEQ ID NO: 6 or Ala at position 257 shown in SEQ ID NO: 6. In an example, the constant region is Fc enhanced, eg, ADCC or CDC enhanced. The skilled person will know techniques (eg, known C region mutations) to enhance ADCC or CDC.

(vii) wherein the ligand comprises a human gamma-3 heavy chain constant region encoded by a first human IGHG3 (eg, IGHG3*01) constant region gene segment and wherein said human comprises (i) said first constant region gene segment (eg, an IGHG3*01), or the human expresses antibodies comprising human gamma-3 heavy chain constant regions encoded by said first human IGHG3 (eg, IGHG3*01) constant region gene segment.

Optionally, the ligand (eg, an antibody or antibody fragment) is according to one of the following options:—

(viii) wherein the ligand comprises a human kappa chain constant region that comprises a Val at position 84 shown in SEQ ID NO: 16 or a Cys at position 87 shown in SEQ ID NO: 16 and wherein said human comprises (i) an IGKC1*01 human kappa chain constant region gene segment, or the human expresses antibodies comprising human kappa chain constant regions comprising a Val corresponding to position 84 shown in SEQ ID NO: 16 or a Cys at position 87 shown in SEQ ID NO: 16.

(ix) wherein the ligand comprises a human IGLC1*01 lambda chain constant region and wherein said human comprises (i) a human IGLC1*01 lambda chain constant region gene segment, or the human expresses antibodies comprising human IGLC1*01 lambda chain constant regions.

(x) wherein the ligand comprises a human epsilon heavy chain constant region encoded by a first human epsilon heavy chain constant region gene segment and wherein said human comprises (i) said first constant region gene segment, or the human expresses antibodies comprising human epsilon heavy chain constant regions encoded by said first constant region gene segment.

(xii) wherein the ligand comprises a human mu heavy chain constant region encoded by a first human mu heavy chain constant region gene segment and wherein said human comprises (i) said first constant region gene segment, or the human expresses antibodies comprising human mu heavy chain constant regions encoded by said first constant region gene segment.

(xiii) wherein the ligand comprises a human alpha heavy chain constant region encoded by a first human alpha heavy chain constant region gene segment and wherein said human comprises (i) said first constant region gene segment, or the human expresses antibodies comprising human alpha heavy chain constant regions encoded by said first constant region gene segment.

(xiv) wherein the ligand comprises a human delta heavy chain constant region encoded by a first human delta heavy chain constant region gene segment and wherein said human comprises (i) said first constant region gene segment, or the human expresses antibodies comprising human delta heavy chain constant regions encoded by said first constant region gene segment.

(xv) wherein the ligand comprises a human kappa light chain constant region encoded by a first human kappa light chain constant region gene segment and wherein said human comprises (i) said first constant region gene segment, or the human expresses antibodies comprising human kappa light chain constant regions encoded by said first constant region gene segment.

(xvi) wherein the ligand comprises a human lambda light chain constant region encoded by a first human lambda light chain constant region gene segment and wherein said human comprises (i) said first constant region gene segment, or the human expresses antibodies comprising human lambda light chain constant regions encoded by said first constant region gene segment.

Example 9

Nav1.8 (SCN10A; PN3; SNS)

Nav1.8 is a sodium ion channel that in humans is encoded by the SCN10A gene (OMIM: 604427). Nav1.8 is a tetrodotoxin (TTX)-resistant voltage-gated sodium ion channel. It is expressed in the dorsal root ganglion (DRG), in unmyelinated, small-diameter sensory neurons called C-fibres and is involved in the pain pathway (nociception). C-fibres can be activated by noxious thermal or mechanical stimuli and thus can carry pain messages. It is known that Nav1.7, Nav1.8 and Nav1.9 are located in the DRG and play an important role in maintaining chronic inflammatory pain. Nav1.8 α-subunit consists of four homologous domains each with six transmembrane spanning regions of which one is a voltage sensor. Nav1.8 contributes the most to sustaining the depolarising stage of the action potentials in nociceptive sensory neurons by activating quickly and remaining activated after detecting a noxious stimuli. Therefore, Nav1.8 is known to perform a key role in hyperalgesia (increased sensitivity to pain) and allodynia (pain from stimuli that do not usually cause it) which are part of chronic pain. Nav1.8 knockout mice studies have shown that the channel is associated with inflammatory and neuropathic pain. Moreover, Nav1.8 plays a crucial role in cold pain. Mutations in SCN10A are associated to Brugada Syndrome.

Human Nav1.8 polymorphism has been observed. Reference is made to the following, the disclosures of which are incorporated herein by reference in their entirety:—

1. Waxman S G et al, Lancet Neurol. 2014 November; 13(11): 1152-60. doi: 10.1016/51474-4422(14)70150-4; "Sodium channel genes in pain-related disorders: phenotype-genotype associations and recommendations for clinical use".
2. Hoeijmakers J G et al, "Neurosci Lett. 2014 Dec. 31. pii: 50304-3940(14)01009-X. doi: 10.1016/j.neulet.2014.12.056; "Painful peripheral neuropathy and sodium channel mutations".
3. Huang J et al, J Neurosci. 2013 Aug. 28; 33(35):14087-97. doi: 10.1523/JNEUROSCI.2710-13.2013; "Small-fiber neuropathy Nav1.8 mutation shifts activation to hyperpolarized potentials and increases excitability of dorsal root ganglion neurons".
4. Han C et al, J Neurol Neurosurg Psychiatry. 2014 May; 85(5):499-505. doi: 10.1136/jnnp-2013-306095. Epub 2013 Sep. 4; "The G1662S NaV1.8 mutation in small fibre neuropathy: impaired inactivation underlying DRG neuron hyperexcitability".
5. Faber C et al, Proc Natl Acad Sci USA. 2012 Nov. 20; 109(47):19444-9. doi: 10.1073/pnas.1216080109. Epub 2012 Oct. 31; "Gain-of-function Nav1.8 mutations in painful neuropathy".
6. Chambers J C et al, Nat Genet. 2010 February; 42(2):149-52. doi: 10.1038/ng.516. Epub 2010 Jan. 10; "Genetic variation in SCN10A influences cardiac conduction".
7. Arisawa T et al, J Gastroenterol. 2013 January; 48(1):73-80. doi: 10.1007/s00535-012-0602-3. Epub 2012 May 23; "Genetic polymorphisms of SCN10A are associated with functional dyspepsia in Japanese subjects".
8. van den Boogaard M et al, J Clin Invest. 2014 April; 124(4):1844-52. doi: 10.1172/JCI73140. Epub 2014 Mar. 18; "A common genetic variant within SCN10A modulates cardiac SCN5A expression".
9. U.S. Pat. No. 7,582,745: "Compositions and methods for inhibiting expression of Nav1.8 gene".
10. Jabbari J et al, Circ Cardiovasc Genet. 2015 February; 8(1):64-73. doi: 10.1161/HCG.0000000000000022; "Common and Rare Variants in SCN10A Modulate the Risk of Atrial Fibrillation".

Mutations in the SCN10A gene account for approximately 5 percent of cases of small fibre neuropathy, a condition characterized by severe pain attacks and a reduced ability to differentiate between hot and cold. The mutations cause amino acid change in the NaV1.8 sodium channel. Many of the mutations result in NaV1.8 sodium channels that open more easily than usual, increasing the flow of sodium ions that produce nerve impulses within nociceptors. This increase in sodium ions enhances transmission of pain signals, causing individuals to be more sensitive to stimulation that might otherwise not cause pain. In this condition, the small fibres that extend from the nociceptors and transmit pain signals (axons) degenerate over time. The cause of this degeneration is unknown, but it likely accounts for signs and symptoms such as the loss of temperature differentiation.

Painful peripheral neuropathies or small-fibre neuropathies are disorders of unmyelinated nociceptive C-fibres causing neuropathic pain and in some cases there is no known cause. A gain-of-function mutation was found in the Nav1.8 encoding SCN10A gene in patients with painful peripheral neuropathy (Faber et al). Faber et al used voltage clamp and current clamp methods along with predictive algorithms on 104 idiopathic patients who did not have the mutation in SCN9A (encoding Nav1.7). They found two gain-of-function mutations in SCN10A in three patients in which both mutations cause increased excitability in DRG sensory neurons and hence they contribute to pain.

Certain common variants (polymorphisms) in the SCN10A gene have been found to increase the risk of developing an irregular heartbeat (arrhythmia). These polymorphisms lead to the production of an altered NaV1.8 sodium channel that can disrupt the electrical signals that control the heartbeat. Specifically, changes in the SCN10A gene are associated with a type of arrhythmia known as heart block. Heart block occurs when the heart's electrical signals are slowed down or interrupted. It is unknown how changes to the NaV1.8 sodium channel lead to heart block.

In an example, the invention provides a method of treating or reducing the risk of a Nav1.8-mediated disease or condition in a human in need thereof, the method comprising administering to said human a ligand (eg, an antibody or antibody fragment) that specifically binds a human Nav1.8 protein. The invention also provides a corresponding ligand.

The present invention provides anti-Nav1.8 ligands; and Nav1.8-binding or targeting ligands as described herein. The ligands have a variety of utilities. Some of the ligands, for instance, are useful in specific binding assays, for genotyping or phenotyping humans, affinity purification of Nav1.8, in particular human Nav1.8 or its ligands and in screening assays to identify other antagonists of Nav1.8 activity. Some of the ligands of the invention are useful for inhibiting Nav1.8-mediated activities.

Anti-Nav1.8 ligands (eg, antibodies and anti-sense RNA) have been developed based on targeting and neutralising so-called "wild-type" human Nav1.8, which is a commonly-occurring form (see, eg, SEQ ID NO: 135). While such ligands may be useful for human patients harbouring this form of human Nav1.8, the inventor considered it useful to investigate the possibility of targeting rarer—but still naturally-occurring—forms of Nav1.8 amongst human populations. In this way, the inventor arrived at insight into the natural occurrences and distributions of rarer human Nav1.8 forms that can serve as useful targets (at the protein or nucleic acid level) for human treatment, prophylaxis and diagnosis pertinent to diseases and conditions mediated or associated with Nav1.8 activity. This particularly provides for tailored therapies, prophylaxis and diagnosis in humans that are devoid of the common Nav1.8 gene or protein.

The skilled person will know that SNPs or other changes that translate into amino acid variation can cause variability in activity and/or conformation of human targets to be addressed. This has spawned great interest in personalized medicine where genotyping and knowledge of protein and nucleotide variability is used to more effectively tailor medicines and diagnosis of patients. The invention, therefore, provides for tailored pharmaceuticals and testing that specifically addresses rarer Nav1.8 polymorphic variant forms. Such forms or "alleles" (at the nucleotide level), comprise one or more changes at the nucleotide and amino acid levels from the corresponding common form nucleotide and amino acids sequences, ie, there are one or more non-synonymous (aka "missense") changes at the nucleotide level that translate into one or more corresponding changes in the protein target in humans.

Furthermore, the inventor surprisingly realised that rarer natural forms, although present in humans at much lower frequencies than the common form, nevertheless are represented in multiple and ethnically-diverse human populations and usually with many human examples per represented ethnic population. Thus, the inventor realised that targeting rarer forms would provide for effective treatment, prophylaxis or diagnosis across many human ethnic populations, thereby extending the utility of the present invention.

With this realisation, the inventor saw that there is significant industrial and medical application for the invention in terms of guiding the choice of anti-Nav1.8 ligand for administration to human patients for therapy and/or prophylaxis of Nav1.8-mediated or associated diseases or conditions. In this way, the patient receives drugs and ligands that are tailored to their needs—as determined by the patient's genetic or phenotypic makeup. Hand-in-hand with this, the invention provides for the genotyping and/or phenotyping of patients in connection with such treatment, thereby allowing a proper match of drug to patient. This increases the chances of medical efficacy, reduces the likelihood of inferior treatment using drugs or ligands that are not matched to the patient (eg, poor efficacy and/or side-effects) and avoids pharmaceutical misprescription and waste.

In developing this thinking, in this non-limiting example a set of human Nav1.8 variants can be determined on the basis of the following criteria, these being criteria that the inventor realised would provide for useful medical drugs and diagnostics to tailored need in the human population. The inventor selected some variants having at least 3 of the 4 following criteria:—

Naturally-occurring human Nav1.8 variation having a cumulative human allele frequency of 35% or less;

Naturally-occurring human Nav1.8 variation having a total human genotype frequency of about 50% or less;

Naturally-occurring human Nav1.8 variation found in many different human ethnic populations (using the standard categorisation of the 1000 Genomes Project; see Table 2 below); and Naturally-occurring human Nav1.8 variation found in many individuals distributed across such many different ethnic populations.

The selection can include, as an additional or alternative consideration, selection for nucleotide variation that produced amino acid variation in corresponding Nav1.8 forms (ie, non-synonymous variations), as opposed to silent variations that do not alter amino acid residues in the target protein.

Variants can also be sourced from Ensembl, 1000 Genomes database or the literature.

The inventor identified variants listed in Table 25 below.

TABLE 25

Nav1.8 - Human Polymorphism & SNPs

| SNP/VARIANT | CHROMOSOMAL LOCATION (FORWARD STRAND) | NUCLEOTIDE CHANGE | AMINO ACID CHANGE | AMINO ACID POSITION | CUMULATIVE FREQUENCY[1] | EXAMPLE CONDITIONS |
|---|---|---|---|---|---|---|
| rs138404783 | 3:38752313 | 1661T > C | L554P | 554 | | Pain Inflammatory pain Neuropathic pain, eg, SFN |
| | | 3910G > A | A1304T | 1304 | | Pain Inflammatory pain Neuropathic pain, eg, SFN |
| | | 4984G > A | I1706V | 1706 | | Pain Inflammatory pain Neuropathic pain, eg, SFN |
| | | 2884A > G | | | | Dyspepsia EPS DPS Gastric pain |
| | | 3218C > T | | | | Dyspepsia EPS DPS Gastric pain |
| *rs6801957 | 3:38725824 | C > T | | | 0.305 | Brugada Syndrome Cardiac pain Cardiac arrhythmia Heart block Ventricular fibrillation Atrial fibrillation |
| **rs6795970 | 3:38725184 | G > A | A1073V | 1073 | 0.264 | Cardiac pain Cardiac arrhythmia Heart block Ventricular fibrillation Atrial fibrillation |
| | | | G1662S | 1662 | | Pain Inflammatory pain Neuropathic pain, eg, SFN |
| ***rs10428132 | 3:38736063 | G > T | | | 0.296 | Brugada Syndrome Cardiac pain Cardiac arrhythmia Heart block Ventricular fibrillation Atrial fibrillation |
| ****rs12632942 | 3:38723507 | A > G | L1092P | 1092 | 0.237 | Pain Inflammatory pain Neuropathic pain, eg, SFN Brugada Syndrome Cardiac pain |

TABLE 25-continued

Nav1.8 - Human Polymorphism & SNPs

| SNP/VARIANT | CHROMOSOMAL LOCATION (FORWARD STRAND) | NUCLEOTIDE CHANGE | AMINO ACID CHANGE | AMINO ACID POSITION | CUMULATIVE FREQUENCY[1] | EXAMPLE CONDITIONS |
|---|---|---|---|---|---|---|
| *****rs57326399 | 3:38726809 | T > C | I962V | 962 | 0.231 | Cardiac arrhythmia Heart block Ventricular fibrillation Atrial fibrillation Pain Inflammatory pain Neuropathic pain, eg, SFN Brugada Syndrome Cardiac pain |
| +rs7630989 | 3:38752449 | A > G | S509P | 509 | 0.137 | Cardiac arrhythmia Heart block Ventricular fibrillation Atrial fibrillation Pain Inflammatory pain Neuropathic pain, eg, SFN Brugada Syndrome Cardiac pain |
| ++rs74717885 | 3:38763578 | T > C | I206M | 206 | 0.048 | Cardiac arrhythmia Heart block Ventricular fibrillation Atrial fibrillation Pain Inflammatory pain Neuropathic pain, eg, SFN Brugada Syndrome Cardiac pain |
| +++rs144270136 | 3:38793743 | G > A | R90W | 90 | 0.009 | Cardiac arrhythmia Heart block Ventricular fibrillation Atrial fibrillation Neuropathic pain, eg, SFN Brugada Syndrome Cardiac pain Cardiac arrhythmia Heart block Ventricular fibrillation Atrial fibrillation |

SFN = small fibre neuropathy or pain associated with small fibre neuropathy
EPS = Epigastric pain syndrome
PDS = Postprandial distress syndrome
[1]According to Ensembl, dbSNP
*rs6801957 is present in humans at an average cumulative frequency of 31% according to the 1000 Genomes Phase I database, but is higher in AMR, EUR, CLM, MXL, PUR, CEU, FIN, GBR, IBS and TSI populations; thus in an embodiment, in the present invention involving Nav1.8 the human is of AMR ancestry, eg, of CLM, MXL or PUR ancestry; or of EUR ancestry, eg, of CEU, FIN, GBR, IBS or TSI ancestry.
**rs6795970 is present in humans at an average cumulative frequency of 26% according to the 1000 Genomes Phase I database, but is higher in AMR, EUR, CLM, MXL, PUR, CEU, FIN, GBR, IBS and TSI populations; thus in an embodiment, in the present invention involving Nav1.8 the human is of AMR ancestry, eg, of CLM, MXL or PUR ancestry; or of EUR ancestry, eg, of CEU, FIN, GBR, IBS or TSI ancestry.
***rs10428132 is present in humans at an average cumulative frequency of 30% according to the 1000 Genomes Phase I database, but is higher in AMR, EUR, CLM, MXL, PUR, CEU, FIN, GBR, IBS and TSI populations; thus in an embodiment, in the present invention involving Nav1.8 the human is of AMR ancestry, eg, of CLM, MXL or PUR ancestry; or of EUR ancestry, eg, of CEU, FIN, GBR, IBS or TSI ancestry.
****rs12632942 is present in humans at an average cumulative frequency of 24% according to the 1000 Genomes Phase I database, but is higher in ASN, EUR, CHB, CHS, JPT, IBS and TSI populations; thus in an embodiment, in the present invention involving Nav1.8 the human is of ASN ancestry, eg, of CHB, CHS or JPT ancestry; or of EUR ancestry, eg, of IBS or TSI ancestry.
*****rs57326399 is present in humans at an average cumulative frequency of 23% according to the 1000 Genomes Phase I database, but is higher in ASN, EUR, CHB, CHS, JPT, CEU, GBR, IBS and TSI populations; thus in an embodiment, in the present invention involving Nav1.8 the human is of ASN ancestry, eg, of CHB, CHS or JPT ancestry; or of EUR ancestry, eg, of CEU, GBR, IBS or TSI ancestry.

TABLE 25-continued

Nav1.8 - Human Polymorphism & SNPs

| SNP/VARIANT | CHROMOSOMAL LOCATION (FORWARD STRAND) | NUCLEOTIDE CHANGE | AMINO ACID CHANGE | AMINO ACID POSITION | CUMULATIVE FREQUENCY[1] | EXAMPLE CONDITIONS |
|---|---|---|---|---|---|---|

+rs7630989 is present in humans at an average cumulative frequency of 14% according to the 1000 Genomes Phase I database, but is higher in AFR, ASN, ASW, LWK, YRI, CHB, CHS and JPT populations; thus in an embodiment, in the present invention involving Nav1.8 the human is of ASN ancestry, eg, of CHB, CHS or JPT ancestry; or of EUR ancestry, eg, of CEU, GBR, IBS or TSI ancestry.
++rs74717885 is present in humans at an average cumulative frequency of 5% according to the 1000 Genomes Phase I database, but is higher in ASN, CHB, CHS and JPT populations; thus in an embodiment, in the present invention involving Nav1.8 the human is of ASN ancestry, eg, of CHB, CHS or JPT ancestry.
+++rs144270136 is present in humans at an average cumulative frequency of 5% according to the 1000 Genomes Phase I database, but is higher in ASN, CHB, CHS and JPT populations; thus in an embodiment, in the present invention involving Nav1.8 the human is of ASN ancestry, eg, of CHB, CHS or JPT ancestry.

In an embodiment, variations are with reference to transcript ENST00000449082 (the sequence of this transcript being incorporated herein in its entirety).

Optionally for any mutation, the condition is a condition listed in Table 25.

In an embodiment, the human comprises a SNP selected from the SNPs in column 1 of Table 25; optionally also the ligand specifically binds a human Nav1.8 encoded by a nucleotide sequence comprising said SNP.

In an embodiment, the human comprises a Nav1.8 amino acid variation selected from the variations in column 4 of Table 25; optionally also the ligand specifically binds a human Nav1.8 comprising said variation.

In an example, the invention provides a method of treating or reducing the risk of a Nav1.8-mediated disease or condition in a human in need thereof, the method comprising administering to said human a ligand (eg, an antibody or antibody fragment) that specifically binds a human Nav1.8 protein that comprises an amino acid selected from the group consisting of L554P, A1304T, I1706V, A1073V, G1662S, L1092P, I962V, S509P, I206M and R90W or an amino acid encoded by a SNP selected from the group consisting of rs6801957, rs6795970, rs10428132, rs12632942, rs57326399, rs7630989, rs74717885 and rs144270136; optionally selected from the group consisting of L554P, A1304T, I1706V and G1662S (eg, when the condition is neuropathic pain). These amino acid variations are found in naturally-occurring Nav1.8 variants in humans. Said human comprises a nucleotide sequence encoding a Nav1.8 protein comprising said selected amino acid.

In an example, the selected amino acid is L554P. In an example, the selected amino acid is A1304T. In an example, the selected amino acid is I1706V. In an example, the selected amino acid is G1662S.

The disease or condition is, for example, any disease or condition described above in the Example relating to Nav1.7 and the disclosure of such diseases and conditions are hereby also imported into this example to provide for possible combination of the present invention relating to Nav1.8 (eg, for use in one or more claims herein). In one embodiment, the condition is a condition listed in Table 25 or a symptom of such a condition. In an example, the condition is pain or a symptom of pain, eg, a symptom of neuropathic pain. In an example, the condition is selected from the group consisting of paroxysmal pain (eg, of hands and/or feet), hand pain, foot pain, limb pain (eg, leg pain), cramp (eg, foot cramp or leg cramp), tingling (e, foot, hand or leg tingling) and pain associated with clothing contact with the human. In an example, the condition is an abnormal threshold for warmth or cold sensation (eg, in a foot or feet). In an example, the condition is joint pain. In an example, the condition is dry eye sensation, diarrhea, urinary condition, heart palpitations or dizziness. In an example, the condition is insensitivity to pain. In an example, the condition is episodic pain (eg, familial episodic pain).

In one embodiment, the pain is chronic pain.

In one embodiment, the pain is neuropathic pain, eg, chronic neuropathic pain, eg, peripheral neuropathic pain. For example, the pain is painful diabetic neuropathy (PDN), post-herpetic neuropathy (PHN) or trigeminal neuralgia (TN).

In an example, the pain is spinal cord injury pain, multiple sclerosis pain, phantom limb pain, post-stroke pain, chronic back pain, osteoarthritis pain, cancer-associated pain or HIV-associated pain.

In one embodiment, the pain is inflammatory pain, eg, chronic inflammatory pain.

In an example, the ligand of the invention comprises an anti-human Nav1.8 binding site, wherein the binding site is a human or humanized binding site, eg, the binding site comprises or consists of a human or humanized antibody variable domain or plurality of variable domains (eg, human VH/VL binding site(s)). Additionally or alternatively, the ligand comprises one or more human antibody constant regions (eg, a human antibody CH1, CH2, CH3 (or all of these) or Fc). In an example, the ligand is an antibody that comprises human or humanized variable regions and human constant regions (eg, bearing one or more mutations to enhance or dampen Fc function in a human patient).

An example provides a ligand (eg, an antibody or antibody fragment) for treating or reducing the risk of a Nav1.8-mediated disease or condition in a human in need thereof, the method comprising administering to said human said ligand, wherein the ligand specifically binds a human Nav1.8 protein that comprises an amino acid selected from the group consisting of L554P, A1304T, I1706V, A1073V, G1662S, L1092P, I962V, S509P, I206M and R90W or an amino acid encoded by a SNP selected from the group consisting of rs6801957, rs6795970, rs10428132, rs12632942, rs57326399, rs7630989, rs74717885 and rs144270136; optionally selected from the group consisting of L554P, A1304T, I1706V and G1662S (eg, when the condition is neuropathic pain). Said human comprises a nucleotide sequence encoding a Nav1.8 protein comprising said selected amino acid.

In an example, the invention provides a method of targeting Nav1.8 in a human, the method comprising administering to said human a ligand (eg, an antibody or antibody fragment) that specifically binds a human Nav1.8 protein that comprises an amino acid selected from the group consisting of L554P, A1304T, I1706V, A1073V, G1662S, L1092P, I962V, S509P, I206M and R90W or an amino acid encoded by a SNP selected from the group consisting of rs6801957, rs6795970, rs10428132, rs12632942, rs57326399, rs7630989, rs74717885 and rs144270136; optionally selected from the group consisting of L554P, A1304T, I1706V and G1662S (eg, when the condition is neuropathic pain). Said human comprises a nucleotide sequence encoding a Nav1.8 protein comprising said selected amino acid. In an example, the human is suffering from or at risk of a Nav1.8-mediated disease or condition. In an example, the method treats or reduces the risk of a Nav1.8-mediated disease or condition in the human.

An example also provides a ligand (eg, an antibody or antibody fragment) for targeting Nav1.8 in a human, the method comprising administering to said human said ligand, wherein the ligand specifically binds a human Nav1.8 protein that comprises an amino acid selected from the group consisting of L554P, A1304T, 11706V, A1073V, G1662S, L1092P, I962V, 5509P, 1206M and R90W or an amino acid encoded by a SNP selected from the group consisting of rs6801957, rs6795970, rs10428132, rs12632942, rs57326399, rs7630989, rs74717885 and rs144270136; optionally selected from the group consisting of L554P, A1304T, 11706V and G1662S (eg, when the condition is neuropathic pain). Said human comprises a nucleotide sequence encoding a (eg, said) Nav1.8 protein comprising said selected amino acid. In an example, the human is suffering from or at risk of a Nav1.8-mediated disease or condition. In an example, the method treats or reduces the risk of a Nav1.8-mediated disease or condition in the human.

In an embodiment, (i) the antibody or fragment comprises a VH domain derived from the recombination of a human VH segment, a human D gene segment and a human JH segment, the human VH segment encoding the framework 1 of SEQ ID NO: 40 and wherein said human comprises a VH gene segment encoding the framework 1 of SEQ ID NO: 40, or the human expresses VH domains that comprise the framework 1 of SEQ ID NO: 40; and wherein (ii) said human comprises a nucleotide sequence encoding said Nav1.8 protein comprising said amino acid selected from the group consisting of L554P, A1304T, 11706V, A1073V, G1662S, L1092P, I962V, 5509P, 1206M and R90W or an amino acid encoded by a SNP selected from the group consisting of rs6801957, rs6795970, rs10428132, rs12632942, rs57326399, rs7630989, rs74717885 and rs144270136; optionally selected from the group consisting of L554P, A1304T, 11706V and G1662S (eg, when the condition is neuropathic pain).

Additionally or alternatively, in an embodiment, (i) the antibody or fragment comprises a human gamma-4 heavy chain constant region that comprises a Leu at position 189 shown in SEQ ID NO: 73 or an Arg at position 289 shown in SEQ ID NO: 73 and wherein said human comprises an IGHG4*01 human heavy chain constant region gene segment, or the human expresses antibodies comprising human gamma-4 heavy chain constant regions comprising a Leu at position 189 shown in SEQ ID NO: 73 or an Arg at position 289 shown in SEQ ID NO: 73; and wherein (ii) said human comprises a nucleotide sequence encoding said Nav1.8 protein comprising said amino acid selected from the group consisting of L554P, A1304T, 11706V, A1073V, G1662S, L1092P, I962V, S509P, 1206M and R90W or an amino acid encoded by a SNP selected from the group consisting of rs6801957, rs6795970, rs10428132, rs12632942, rs57326399, rs7630989, rs74717885 and rs144270136; optionally selected from the group consisting of L554P, A1304T, 11706V and G1662S (eg, when the condition is neuropathic pain).

In an example, the ligand, antibody or fragment is for treating or reducing the risk of (or treats or reduces the risk of) pain or itching, optionally wherein the antibody is a humanized mouse or Camelid (eg, llama or camel) antibody.

In a specific embodiment, the anti-Nav1.8 ligand, antibody or fragment also specifically binds to another Nav selected from Nav1.1-1.9, eg, it specifically binds to Nav1.7 or 1.9.

In a specific embodiment, the anti-Nav1.8 ligand, antibody or fragment of present invention comprises an Fc region as per the disclosure in the Nav1.7 example above.

The ligand, antibody or fragment according to the invention is for treating or preventing or reducing the risk of (or treats or prevents or reduces the risk of), for example, any disease or condition disclosed in WO2011/051351 or U.S. Pat. No. 7,582,745, the disclosures of which diseases and conditions are incorporated herein by reference for potential inclusion in one or more claims herein. Guidance on obtaining and testing antibodies can also be found in that PCT application.

Further encompassed by the invention is the use of the ligand, antibody or fragment in the manufacture of a medicament for use to attenuate or inhibit a Nav1.8-mediated disease or disorder in a human. Nav1.8-mediated or related disorders which are treated by the ligand, antibody or fragment of the invention include, for example, a pain or itching disease or condition.

Thus, a ligand, antibody or fragment of the invention is useful as a therapeutic agent in the treatment of a condition involving Nav1.8 expression and/or activity. One embodiment, among others, is a method of treatment comprising administering an effective amount of a ligand, antibody or fragment of the invention to a patient in need thereof, wherein functional consequences of Nav1.8 activation are decreased. Another embodiment, among others, is a method of treatment comprising (i) identifying a patient demonstrating Nav1.8 expression or activity, and (ii) administering an effective amount of a ligand, antibody or fragment of the invention to the patient, wherein a functional consequence of Nav1.8 activation are attenuated. An effective amount according to the invention is an amount that modulates (e.g. decreases) the functional consequences of Nav1.8 activation so as to modulate (e.g. decrease or lessen) the severity of at least one symptom of the particular disease or disorder being treated, but not necessarily cure the disease or disorder. Accordingly, one embodiment of the invention is a method of treating or reducing the severity of at least one symptom of any of the disorders referred to herein, comprising administering to a patient in need thereof an effective amount of one or more ligands, antibodies or fragments of the present invention alone or in a combined therapeutic regimen with another appropriate medicament known in the art or described herein such that the severity of at least one symptom of any of the disorders is reduced. Another embodiment of the invention, among others, is a method of antagonizing at least one effect of Nav1.8 comprising contacting with or administering an effective amount of one or more ligands, antibodies or fragments of the present invention such that said at least one effect of Nav1.8 is antagonized, e.g. the ability of Nav1.8 to form an ion channel, such as a sodium channel.

Tailoring Antibodies to Rarer Nav1.8 Variant Profile

As outlined herein (for example, in the context of PCSK9 in Example 1 or in the context of the Nav1.7 Example herein), the invention includes the possibility to tailor treatment of humans further by selecting antibody-based ligands with variable domains and/or constant domains based on gene segments found in many humans of the ethnic populations where the variant TOI forms are found to meet the selection criteria of the invention. This also applies mutatis mutandis where the TOI is human Nav1.8, as in the present example. Thus, all disclosure herein relating to tailoring variable and/or constant domains apply to the present example, relating to Nav1.8 and is combinable for use in one or more claims herein. All disclosure relating to variable and constant regions and polymorphism under the subtitle "Tailoring Antibodies to Rarer Nav1.7 Variant Profile" in the Nav1.7 Example is also incorporated into the present Nav1.8 Example for use mutatis mutandis with the present Nav1.8 invention and for possible inclusion in Nav1.8-limited claims herein.

Determination of Specific Binding of Ligands of the Invention to NAV1.8 Variants The specific binding of ligands of the invention to Nav1.8 variants can be performed using the SPR method described in Example 1.

Embodiments are provided as follows:—
Methods with VH Tailoring

1. A method of treating or reducing the risk of a Nav1.8-mediated disease or condition in a human in need thereof, the method comprising administering to said human a ligand (eg, an antibody or antibody fragment) that specifically binds a human Nav1.8 protein that comprises an amino acid selected from the group consisting of L554P, A1304T, I1706V, A1073V, G1662S, L1092P, I962V, S509P, I206M and R90W or an amino acid encoded by a SNP selected from the group consisting of rs6801957, rs6795970, rs10428132, rs12632942, rs57326399, rs7630989, rs74717885 and rs144270136; optionally selected from the group consisting of L554P, A1304T, I1706V and G1662S (eg, when the condition is neuropathic pain);
    wherein (i) the ligand comprises a VH domain derived from the recombination of a human VH segment, a human D gene segment and a human JH segment, the human VH segment encoding the framework 1 of SEQ ID NO: 40 and wherein said human comprises a VH gene segment encoding the framework 1 of SEQ ID NO: 40, or the human expresses VH domains that comprise the framework 1 of SEQ ID NO: 40; and
    wherein (ii) said human comprises a nucleotide sequence encoding said Nav1.8 protein comprising said amino acid selected from the group consisting of L554P, A1304T, I1706V, A1073V, G1662S, L1092P, I962V, S509P, I206M and R90W or an amino acid encoded by a SNP selected from the group consisting of rs6801957, rs6795970, rs10428132, rs12632942, rs57326399, rs7630989, rs74717885 and rs144270136; optionally selected from the group consisting of L554P, A1304T, I1706V and G1662S (eg, when the condition is neuropathic pain).

In an alternative, clause 1 provides:—

A method of targeting Nav1.8 in a human, the method comprising administering to said human a ligand (eg, an antibody or antibody fragment) that specifically binds a human Nav1.8 protein that comprises an amino acid selected from the group consisting of L554P, A1304T, I1706V, A1073V, G1662S, L1092P, I962V, S509P, I206M and R90W or an amino acid encoded by a SNP selected from the group consisting of rs6801957, rs6795970, rs10428132, rs12632942, rs57326399, rs7630989, rs74717885 and rs144270136; optionally selected from the group consisting of L554P, A1304T, I1706V and G1662S (eg, when the condition is neuropathic pain); wherein (i) the ligand comprises a VH domain derived from the recombination of a human VH segment, a human D gene segment and a human JH segment, the human VH segment encoding the framework 1 of SEQ ID NO: 40 and wherein said human comprises a VH gene segment encoding the framework 1 of SEQ ID NO: 40, or the human expresses VH domains that comprise the framework 1 of SEQ ID NO: 40; and wherein (ii) said human comprises a nucleotide sequence encoding said Nav1.8 protein comprising said amino acid selected from the group consisting of L554P, A1304T, I1706V, A1073V, G1662S, L1092P, I962V, S509P, I206M and R90W or an amino acid encoded by a SNP selected from the group consisting of rs6801957, rs6795970, rs10428132, rs12632942, rs57326399, rs7630989, rs74717885 and rs144270136; optionally selected from the group consisting of L554P, A1304T, I1706V and G1662S (eg, when the condition is neuropathic pain).

In an example, the human is suffering from or at risk of a Nav1.8-mediated disease or condition.

In an example, the method treats or reduces the risk of a Nav1.8-mediated disease or condition in the human.

2. The method of clause 1, wherein said amino acid is selected from the group consisting of L554P, A1304T, I1706V and G1662S; optionally wherein said disease or condition is a pain disease or condition, eg, inflammatory pain or neuropathic pain, (eg, SFN).

3. The method of clause 1, wherein said amino acid is selected from the group consisting of 2884A>G and 3218C>T; optionally wherein said disease or condition is pain or is selected from dyspepsia, EPS, DPS and gastric pain.

4. The method of clause 1, wherein said amino acid is encoded by a SNP selected from the group consisting of rs6801957, rs6795970 and rs10428132; optionally wherein said disease or condition is selected from the group consisting of Brugada syndrome, cardiac pain, cardiac arrhythmia, heart block, ventricular fibrillation and atrial fibrillation.

5. The method of any preceding clause, wherein the VH gene segment comprised by said human is a germline VH gene segment.

6. The method of any preceding clause comprising, before said administering, selecting a human comprising said nucleotide sequence of (ii), wherein the human is the human of clause 1.

7. The method of any preceding clause, wherein the human has been determined to comprise the nucleotide sequence that encodes a Nav1.8 protein comprising said selected amino acid and/or a Nav1.8 protein comprising said selected amino acid.

8. The method of any preceding clause, comprising the step of determining that the human comprises (a) the nucleotide sequence that encodes a Nav1.8 protein comprising said selected amino acid and/or (b) a Nav1.8 protein comprising said selected amino acid, optionally, wherein the determining step is performed before administration of the antibody to the human.

9. The method of clause 8, wherein the step of determining comprises assaying a biological sample from the human for a nucleotide sequence encoding a Nav1.8 protein comprising said selected amino acid.

10. The method of clause 9, wherein the assaying comprises contacting the biological sample with at least one oligonucleotide probe comprising a sequence of at least 10 contiguous nucleotides of a nucleotide sequence encoding a Nav1.8 protein comprising said selected amino acid or comprising an antisense sequence of said contiguous nucleotides, wherein said sequence of contiguous nucleotides comprises a nucleotide sequence encoding said selected amino acid, thereby forming a complex when at least one nucleotide sequence encoding the Nav1.8 protein comprising said selected amino acid is present; and detecting the presence or absence of the complex, wherein detecting the presence of the complex determines that the human comprises the Nav1.8 protein comprising said selected amino acid.

11. The method of clause 9, wherein the assaying comprises nucleic acid amplification and optionally one or more methods selected from sequencing, next generation sequencing, nucleic acid hybridization, and allele-specific amplification and/or wherein the assaying is performed in a multiplex format.
12. The method of clause 9 or 11, wherein said biological sample comprises serum, blood, feces, tissue, a cell, urine and/or saliva of said human.
13. The method of any preceding clause, wherein said human is indicated as heterozygous for a nucleotide sequence encoding the Nav1.8 protein comprising said selected amino acid, optionally, wherein said human is further indicated as comprising the nucleotide sequence of SEQ ID NO: 136 or said human is indicated as homozygous for a nucleotide sequence encoding the Nav1.8 protein comprising said selected amino acid.
14. The method of any preceding clause, wherein said human is or has been further determined to be substantially resistant to a pain or itching treatment.
15. The method of any preceding clause, wherein said human is receiving or has received a pain or itching treatment or has reduced responsiveness to a pain or itching treatment.
16. The method of any preceding clause, wherein said disease or condition is a pain or itching disease or condition.
17. The method of any preceding clause, wherein said disease or condition is neuropathic pain.
18. The method of any preceding clause, wherein said human has been diagnosed with at least one condition recited in clause 16 or 17.
19. The method of any preceding clause, wherein said antibody or antibody fragment treats or reduces the risk in said human of a condition recited in clause 16 or 17.
20. The method of any preceding clause, wherein the nucleotide sequence comprises one or more SNPs selected from the group consisting of rs138404783, rs6801957, rs6795970, rs10428132, rs12632942, rs57326399, rs7630989, rs74717885 and rs144270136.
21. The method of any preceding clause, wherein said ligand (eg, antibody or antibody fragment) is administered by inhaled, intravenous or subcutaneous administration and/or is comprised in an inhalable or injectable preparation.

Ligands with VH Tailoring

1. A ligand (eg, an antibody or antibody fragment) for use in a method of treating or reducing the risk of a Nav1.8-mediated disease or condition (eg, asthma) in a human in need thereof, wherein the ligand specifically binds a human Nav1.8 protein that comprises an amino acid selected from the group consisting of L554P, A1304T, I1706V, A1073V, G1662S, L1092P, I962V, S509P, 1206M and R90W or an amino acid encoded by a SNP selected from the group consisting of rs6801957, rs6795970, rs10428132, rs12632942, rs57326399, rs7630989, rs74717885 and rs144270136; optionally selected from the group consisting of L554P, A1304T, I1706V and G1662S (eg, when the condition is neuropathic pain);
   wherein (i) the ligand comprises a VH domain derived from the recombination of a human VH segment, a human D gene segment and a human JH segment, the human VH segment encoding the framework 1 of SEQ ID NO: 40 and wherein said human comprises a VH gene segment encoding the framework 1 of SEQ ID NO: 40, or the human expresses VH domains that comprise the framework 1 of SEQ ID NO: 40; and
   wherein (ii) said human comprises a nucleotide sequence encoding said Nav1.8 protein comprising said amino acid selected from the group consisting of L554P, A1304T, I1706V, A1073V, G1662S, L1092P, I962V, S509P, 1206M and R90W or an amino acid encoded by a SNP selected from the group consisting of rs6801957, rs6795970, rs10428132, rs12632942, rs57326399, rs7630989, rs74717885 and rs144270136; optionally selected from the group consisting of L554P, A1304T, I1706V and G1662S (eg, when the condition is neuropathic pain).

In an alternative, paragraph 1 provides:—

A ligand (eg, an antibody or antibody fragment) for use in a method of targeting Nav1.8 in a human, wherein the ligand specifically binds a human Nav1.8 protein that comprises an amino acid selected from the group consisting of L554P, A1304T, I1706V, A1073V, G1662S, L1092P, I962V, 5509P, 1206M and R90W or an amino acid encoded by a SNP selected from the group consisting of rs6801957, rs6795970, rs10428132, rs12632942, rs57326399, rs7630989, rs74717885 and rs144270136; optionally selected from the group consisting of L554P, A1304T, I1706V and G1662S (eg, when the condition is neuropathic pain);
wherein (i) the ligand comprises a VH domain derived from the recombination of a human VH segment, a human D gene segment and a human JH segment, the human VH segment encoding the framework 1 of SEQ ID NO: 40 and wherein said human comprises a VH gene segment encoding the framework 1 of SEQ ID NO: 40, or the human expresses VH domains that comprise the framework 1 of SEQ ID NO: 40; and
wherein (ii) said human comprises a nucleotide sequence encoding said Nav1.8 protein comprising said amino acid selected from the group consisting of L554P, A1304T, I1706V, A1073V, G1662S, L1092P, I962V, 5509P, 1206M and R90W or an amino acid encoded by a SNP selected from the group consisting of rs6801957, rs6795970, rs10428132, rs12632942, rs57326399, rs7630989, rs74717885 and rs144270136; optionally selected from the group consisting of L554P, A1304T, I1706V and G1662S (eg, when the condition is neuropathic pain).

In an example, the human is suffering from or at risk of a Nav1.8-mediated disease or condition.

In an example, the method treats or reduces the risk of a Nav1.8-mediated disease or condition in the human.

2. The ligand of any preceding clause, wherein said amino acid is selected from the group consisting of L554P, A1304T, I1706V and G1662S; optionally wherein said disease or condition is a pain disease or condition, eg, inflammatory pain or neuropathic pain, (eg, SFN).
3. The ligand of any preceding clause, wherein said amino acid is selected from the group consisting of 2884A>G and 3218C>T; optionally wherein said disease or condition is pain or is selected from dyspepsia, EPS, DPS and gastric pain.
4. The ligand of any preceding clause, wherein said amino acid is selected from the group consisting of rs6801957, rs6795970 and rs10428132; optionally wherein said disease or condition is selected from the group consisting of Brugada syndrome, cardiac pain, cardiac arrhythmia, heart block, ventricular fibrillation and atrial fibrillation.
5. The ligand of any preceding clause, wherein the VH gene segment comprised by said human is a germline VH gene segment.

6. The ligand of any preceding clause said method comprising, before said administering, selecting a human comprising said nucleotide sequence of (ii), wherein the human is the human of clause 1.
7. The ligand of any preceding clause, wherein the human has been determined to comprise the nucleotide sequence that encodes a Nav1.8 protein comprising said selected amino acid selected and/or a Nav1.8 protein comprising said selected amino acid.
8. The ligand of any preceding clause, said method comprising the step of determining that the human comprises (a) the nucleotide sequence that encodes a Nav1.8 protein comprising said selected amino acid and/or (b) a Nav1.8 protein comprising said selected amino acid, optionally, wherein the determining step is performed before administration of the antibody to the human.
9. The ligand of clause 8, wherein the step of determining comprises assaying a biological sample from the human for a nucleotide sequence encoding a Nav1.8 protein comprising said selected amino acid.
10. The ligand of clause 9, wherein the assaying comprises contacting the biological sample with at least one oligonucleotide probe comprising a sequence of at least 10 contiguous nucleotides of a nucleotide sequence encoding a Nav1.8 protein comprising said selected amino acid or comprising an antisense sequence of said contiguous nucleotides, wherein said sequence of contiguous nucleotides comprises a nucleotide sequence encoding said selected amino acid, thereby forming a complex when at least one nucleotide sequence encoding the Nav1.8 protein comprising said selected amino acid is present; and
detecting the presence or absence of the complex, wherein detecting the presence of the complex determines that the human comprises the Nav1.8 protein comprising said selected amino acid.
11. The ligand of clause 9, wherein the assaying comprises nucleic acid amplification and optionally one or more methods selected from sequencing, next generation sequencing, nucleic acid hybridization, and allele-specific amplification and/or wherein the assaying is performed in a multiplex format.
12. The ligand of clause 9 or 11, wherein said biological sample comprises serum, blood, feces, tissue, a cell, urine and/or saliva of said human.
13. The ligand of any preceding clause, wherein said human is indicated as heterozygous for a nucleotide sequence encoding the Nav1.8 protein comprising said selected amino acid, optionally, wherein said human is further indicated as comprising the nucleotide sequence of SEQ ID NO: 136, or said human is indicated as homozygous for a nucleotide sequence encoding the Nav1.8 protein comprising said selected amino acid.
14. The ligand of any preceding clause, wherein said human is or has been further determined to be substantially resistant to a pain or itching treatment.
15. The ligand of any preceding clause, wherein said human is receiving or has received a pain or itching treatment or has reduced responsiveness to a pain or itching treatment.
16. The ligand of any preceding clause, wherein said disease or condition is a pain or itching disease or condition.
17. The ligand of any preceding clause, wherein said disease or condition is neuropathic pain.
18. The ligand of any preceding clause, wherein said human has been diagnosed with at least one condition recited in clause 16 or 17.
19. The ligand of any preceding clause, wherein said antibody or antibody fragment treats or reduces the risk in said human of a condition recited in clause 16 or 17.
20. The ligand of any preceding clause, wherein the nucleotide sequence comprises one or more SNPs selected from the group consisting of rs138404783, rs6801957, rs6795970, rs10428132, rs12632942, rs57326399, rs7630989, rs74717885 and rs144270136.
21. The ligand of any preceding clause, wherein said ligand (eg, antibody or antibody fragment) is for inhaled, intravenous or subcutaneous administration and/or is comprised in an inhalable or injectable preparation.

Methods with Gamma-4 Constant Region Tailoring

1. A method of treating or reducing the risk of a Nav1.8-mediated disease or condition in a human in need thereof, the method comprising administering to said human a ligand (eg, an antibody or antibody fragment) that specifically binds a human Nav1.8 protein that comprises an amino acid selected from the group consisting of L554P, A1304T, I1706V, A1073V, G1662S, L1092P, I962V, S509P, I206M and R90W or an amino acid encoded by a SNP selected from the group consisting of rs6801957, rs6795970, rs10428132, rs12632942, rs57326399, rs7630989, rs74717885 and rs144270136; optionally selected from the group consisting of L554P, A1304T, I1706V and G1662S (eg, when the condition is neuropathic pain);
wherein (i) the ligand comprises a human gamma-4 heavy chain constant region that comprises a Leu at position 189 shown in SEQ ID NO: 73 or an Arg at position 289 shown in SEQ ID NO: 73 and wherein said human comprises (i) an IGHG4*01 human heavy chain constant region gene segment, or the human expresses antibodies comprising human gamma-4 heavy chain constant regions comprising a Leu at position 189 shown in SEQ ID NO: 73 or an Arg at position 289 shown in SEQ ID NO: 73; and
wherein (ii) said human comprises a nucleotide sequence encoding said Nav1.8 protein comprising said amino acid selected from the group consisting of L554P, A1304T, I1706V, A1073V, G1662S, L1092P, I962V, S509P, I206M and R90W or an amino acid encoded by a SNP selected from the group consisting of rs6801957, rs6795970, rs10428132, rs12632942, rs57326399, rs7630989, rs74717885 and rs144270136; optionally selected from the group consisting of L554P, A1304T, I1706V and G1662S (eg, when the condition is neuropathic pain).

In an alternative, clause 1 provides:—

A method of targeting Nav1.8 in a human, the method comprising administering to said human a ligand (eg, an antibody or antibody fragment) that specifically binds a human Nav1.8 protein that comprises an amino acid selected from the group consisting of L554P, A1304T, I1706V, A1073V, G1662S, L1092P, I962V, S509P, I206M and R90W or an amino acid encoded by a SNP selected from the group consisting of rs6801957, rs6795970, rs10428132, rs12632942, rs57326399, rs7630989, rs74717885 and rs144270136; optionally selected from the group consisting of L554P, A1304T, I1706V and G1662S (eg, when the condition is neuropathic pain); wherein (i) the ligand comprises a human gamma-4 heavy chain constant region that comprises a Leu at position 189 shown in SEQ ID NO: 73 or an Arg at position 289 shown in SEQ ID NO: 73 and wherein said human comprises (i) an IGHG4*01 human heavy chain constant region gene segment, or the human expresses antibodies comprising human gamma-4 heavy chain constant regions comprising a Leu at position 189 shown in SEQ ID NO: 73 or an Arg at position 289 shown in SEQ ID NO: 73; and
wherein (ii) said human comprises a nucleotide sequence encoding said Nav1.8 protein comprising said amino acid selected from the group consisting of L554P, A1304T, 11706V, A1073V, G1662S, L1092P, I962V, 5509P, 1206M and R90W or an amino acid encoded by a SNP selected from the group consisting of rs6801957, rs6795970, rs10428132, rs12632942, rs57326399, rs7630989, rs74717885 and rs144270136; optionally selected from the group consisting of L554P, A1304T, 11706V and G1662S (eg, when the condition is neuropathic pain).

In an example, the human is suffering from or at risk of a Nav1.8-mediated disease or condition.

In an example, the method treats or reduces the risk of a Nav1.8-mediated disease or condition in the human.

2. The method of any preceding clause, wherein said amino acid is selected from the group consisting of L554P, A1304T, 11706V and G1662S; optionally wherein said disease or condition is a pain disease or condition, eg, inflammatory pain or neuropathic pain, (eg, SFN).
3. The method of any preceding clause, wherein said amino acid is selected from the group consisting of 2884A>G and 3218C>T; optionally wherein said disease or condition is pain or is selected from dyspepsia, EPS, DPS and gastric pain.
4. The method of any preceding clause, wherein said amino acid is encoded by a SNP selected from the group consisting of rs6801957, rs6795970 and rs10428132; optionally wherein said disease or condition is selected from the group consisting of Brugada syndrome, cardiac pain, cardiac arrhythmia, heart block, ventricular fibrillation and atrial fibrillation.
5. The method of any preceding clause, wherein the constant region gene segment comprised by said human is a germline gene segment.
6. The method of any preceding clause comprising, before said administering, selecting a human comprising said nucleotide sequence of (ii), wherein the human is the human of clause 1.
7. The method of any preceding clause, wherein the human has been determined to comprise the nucleotide sequence that encodes a Nav1.8 protein comprising said selected amino acid and/or a Nav1.8 protein comprising said selected amino acid.
8. The method of any preceding clause, comprising the step of determining that the human comprises (a) the nucleotide sequence that encodes a Nav1.8 protein comprising said selected amino acid and/or (b) a Nav1.8 protein comprising said selected amino acid, optionally, wherein the determining step is performed before administration of the antibody to the human.
9. The method of clause 8, wherein the step of determining comprises assaying a biological sample from the human for a nucleotide sequence encoding a Nav1.8 protein comprising said selected amino acid.
10. The method of clause 9, wherein the assaying comprises contacting the biological sample with at least one oligonucleotide probe comprising a sequence of at least 10 contiguous nucleotides of a nucleotide sequence encoding a Nav1.8 protein comprising said selected amino acid or comprising an antisense sequence of said contiguous nucleotides, wherein said sequence of contiguous nucleotides comprises a nucleotide sequence encoding said selected amino acid, thereby forming a complex when at least one nucleotide sequence encoding the Nav1.8 protein comprising said selected amino acid is present; and
detecting the presence or absence of the complex, wherein detecting the presence of the complex determines that the human comprises the Nav1.8 protein comprising said selected amino acid.
11. The method of clause 9, wherein the assaying comprises nucleic acid amplification and optionally one or more methods selected from sequencing, next generation sequencing, nucleic acid hybridization, and allele-specific amplification and/or wherein the assaying is performed in a multiplex format.
12. The method of clause 9 or 11, wherein said biological sample comprises serum, blood, feces, tissue, a cell, urine and/or saliva of said human.
13. The method of any preceding clause, wherein said human is indicated as heterozygous for a nucleotide sequence encoding the Nav1.8 protein comprising said selected amino acid, optionally, wherein said human is further indicated as comprising the nucleotide sequence of SEQ ID NO: 136 or said human is indicated as homozygous for a nucleotide sequence encoding the Nav1.8 protein comprising said selected amino acid.
14. The method of any preceding clause, wherein said human is or has been further determined to be substantially resistant to a pain or itching treatment.
15. The method of any preceding clause, wherein said human is receiving or has received a pain or itching treatment or has reduced responsiveness to a pain or itching treatment.
16. The method of any preceding clause, wherein said disease or condition is a pain or itching disease or condition.
17. The method of any preceding clause, wherein said disease or condition is neuropathic pain.
18. The method of any preceding clause, wherein said human has been diagnosed with at least one condition recited in clause 16 or 17.
19. The method of any preceding clause, wherein said antibody or antibody fragment treats or reduces the risk in said human of a condition recited in clause 16 or 17.
20. The method of any preceding clause, wherein the nucleotide sequence comprises one or more SNPs selected from the group consisting rs138404783, rs6801957, rs6795970, rs10428132, rs12632942, rs57326399, rs7630989, rs74717885 and rs144270136.
21. The method of any preceding clause, wherein said ligand (eg, antibody or antibody fragment) is administered by inhaled, intravenous or subcutaneous administration and/or is comprised in an inhalable or injectable preparation.
22. The method of any preceding clause, wherein the human gamma-4 heavy chain constant region of the ligand comprises the amino acid sequence of SEQ ID NO: 73 or an ADCC inactivated version thereof.
23. The method of any preceding clause, wherein the human gamma-4 heavy chain constant region comprises 228P and 235E.

Ligands with Gamma-4 Constant Region Tailoring

1. A ligand (eg, an antibody or antibody fragment) for use in a method of treating or reducing the risk of a Nav1.8-mediated disease or condition (eg, pain) in a human in need thereof, wherein the ligand specifically binds a human Nav1.8 protein that comprises an amino acid selected from the group consisting of L554P, A1304T, 11706V, A1073V, G1662S, L1092P, I962V, 5509P, 1206M and R90W or an amino acid encoded by a SNP selected from the group consisting of rs6801957, rs6795970, rs10428132, rs12632942, rs57326399, rs7630989, rs74717885 and rs144270136; optionally selected from the group consisting of L554P, A1304T, I1706V and G1662S (eg, when the condition is neuropathic pain);
  wherein (i) the ligand comprises a human gamma-4 heavy chain constant region that comprises a Leu at position 189 shown in SEQ ID NO: 73 or an Arg at position 289 shown in SEQ ID NO: 73 and wherein said human comprises (i) an IGHG4*01 human heavy chain constant region gene segment, or the human expresses antibodies comprising human gamma-4 heavy chain constant regions comprising a Leu at position 189 shown in SEQ ID NO: 73 or an Arg at position 289 shown in SEQ ID NO: 73; and
  wherein (ii) said human comprises a nucleotide sequence encoding said Nav1.8 protein comprising said amino acid selected from the group consisting of L554P, A1304T, I1706V, A1073V, G1662S, L1092P, I962V, 5509P, 1206M and R90W or an amino acid encoded by a SNP selected from the group consisting of rs6801957, rs6795970, rs10428132, rs12632942, rs57326399, rs7630989, rs74717885 and rs144270136; optionally selected from the group consisting of L554P, A1304T, I1706V and G1662S (eg, when the condition is neuropathic pain).

In an alternative, paragraph 1 provides:—

A ligand (eg, an antibody or antibody fragment) for use in a method of targeting Nav1.8 in a human, wherein the ligand specifically binds a human Nav1.8 protein that comprises an amino acid selected from the group consisting of L554P, A1304T, I1706V, A1073V, G1662S, L1092P, I962V, 5509P, 1206M and R90W or an amino acid encoded by a SNP selected from the group consisting of rs6801957, rs6795970, rs10428132, rs12632942, rs57326399, rs7630989, rs74717885 and rs144270136; optionally selected from the group consisting of L554P, A1304T, I1706V and G1662S (eg, when the condition is neuropathic pain);
wherein (i) the ligand comprises a human gamma-4 heavy chain constant region that comprises a Leu at position 189 shown in SEQ ID NO: 73 or an Arg at position 289 shown in SEQ ID NO: 73 and wherein said human comprises (i) an IGHG4*01 human heavy chain constant region gene segment, or the human expresses antibodies comprising human gamma-4 heavy chain constant regions comprising a Leu at position 189 shown in SEQ ID NO: 73 or an Arg at position 289 shown in SEQ ID NO: 73; and
wherein (ii) said human comprises a nucleotide sequence encoding said Nav1.8 protein comprising said amino acid selected from the group consisting of L554P, A1304T, I1706V, A1073V, G1662S, L1092P, I962V, 5509P, 1206M and R90W or an amino acid encoded by a SNP selected from the group consisting of rs6801957, rs6795970, rs10428132, rs12632942, rs57326399, rs7630989, rs74717885 and rs144270136; optionally selected from the group consisting of L554P, A1304T, I1706V and G1662S (eg, when the condition is neuropathic pain).

In an example, the human is suffering from or at risk of a Nav1.8-mediated disease or condition.

In an example, the method treats or reduces the risk of a Nav1.8-mediated disease or condition in the human.

2. The ligand of any preceding clause, wherein said amino acid is selected from the group consisting of L554P, A1304T, I1706V and G1662S; optionally wherein said disease or condition is a pain disease or condition, eg, inflammatory pain or neuropathic pain, (eg, SFN).

3. The ligand of any preceding clause, wherein said amino acid is selected from the group consisting of 2884A>G and 3218C>T; optionally wherein said disease or condition is pain or is selected from dyspepsia, EPS, DPS and gastric pain.

4. The ligand of any preceding clause, wherein said amino acid is encoded by a SNP selected from the group consisting of rs6801957, rs6795970 and rs10428132; optionally wherein said disease or condition is selected from the group consisting of Brugada syndrome, cardiac pain, cardiac arrhythmia, heart block, ventricular fibrillation and atrial fibrillation.

5. The ligand of any preceding clause, wherein the constant region gene segment comprised by said human is a germline gene segment.

6. The ligand of any preceding clause said method comprising, before said administering, selecting a human comprising said nucleotide sequence of (ii), wherein the human is the human of clause 1.

7. The ligand of any preceding clause, wherein the human has been determined to comprise the nucleotide sequence that encodes a Nav1.8 protein comprising said selected amino acid and/or a Nav1.8 protein comprising said selected amino acid.

8. The ligand of any preceding clause, said method comprising the step of determining that the human comprises (a) the nucleotide sequence that encodes a Nav1.8 protein comprising said selected amino acid and/or (b) a Nav1.8 protein comprising said selected amino acid, optionally, wherein the determining step is performed before administration of the antibody to the human.

9. The ligand of clause 8, wherein the step of determining comprises assaying a biological sample from the human for a nucleotide sequence encoding a Nav1.8 protein comprising said selected amino acid.

10. The ligand of clause 9, wherein the assaying comprises contacting the biological sample with at least one oligonucleotide probe comprising a sequence of at least 10 contiguous nucleotides of a nucleotide sequence encoding a Nav1.8 protein comprising said selected amino acid or comprising an antisense sequence of said contiguous nucleotides, wherein said sequence of contiguous nucleotides comprises a nucleotide sequence encoding said selected amino acid, thereby forming a complex when at least one nucleotide sequence encoding the Nav1.8 protein comprising said selected amino acid is present; and
detecting the presence or absence of the complex, wherein detecting the presence of the complex determines that the human comprises the Nav1.8 protein comprising said selected amino acid.

11. The ligand of clause 9, wherein the assaying comprises nucleic acid amplification and optionally one or more methods selected from sequencing, next generation sequencing, nucleic acid hybridization, and allele-specific amplification and/or wherein the assaying is performed in a multiplex format.

12. The ligand of clause 9 or 11, wherein said biological sample comprises serum, blood, feces, tissue, a cell, urine and/or saliva of said human.

13. The ligand of any preceding clause, wherein said human is indicated as heterozygous for a nucleotide sequence encoding the Nav1.8 protein comprising said selected amino acid, optionally, wherein said human is further indicated as comprising the nucleotide sequence of SEQ ID NO: 136, or said human is indicated as homozygous for a nucleotide sequence encoding the Nav1.8 protein comprising said selected amino acid.

14. The ligand of any preceding clause, wherein said human is or has been further determined to be substantially resistant to a pain or itching treatment.
15. The ligand of any preceding clause, wherein said human is receiving or has received a pain or itching treatment or has reduced responsiveness to a pain or itching treatment.
16. The ligand of any preceding clause, wherein said disease or condition is a pain or itching disease or condition.
17. The ligand of any preceding clause, wherein said disease or condition is neuropathic pain.
18. The ligand of any preceding clause, wherein said human has been diagnosed with at least one condition recited in clause 16 or 17.
19. The ligand of any preceding clause, wherein said antibody or antibody fragment treats or reduces the risk in said human of a condition recited in clause 16 or 17.
20. The ligand of any preceding clause, wherein the nucleotide sequence comprises one or more SNPs selected from the group consisting of rs138404783, rs6801957, rs6795970, rs10428132, rs12632942, rs57326399, rs7630989, rs74717885 and rs144270136.
21. The ligand of any preceding clause, wherein said ligand (eg, antibody or antibody fragment) is for inhaled, intravenous or subcutaneous administration and/or is comprised in an inhalable or injectable preparation.
22. The ligand of any preceding clause, wherein the human gamma-4 heavy chain constant region of the ligand comprises the amino acid sequence of SEQ ID NO: 73 or an ADCC inactivated version thereof.
23. The ligand of any preceding clause, wherein the human gamma-4 heavy chain constant region comprises 228P and 235E.

Methods with Gamma-2 Constant Region Tailoring

1. A method of treating or reducing the risk of a Nav1.8-mediated disease or condition in a human in need thereof, the method comprising administering to said human a ligand (eg, an antibody or antibody fragment) that specifically binds a human Nav1.8 protein that comprises an amino acid selected from the group consisting of L554P, A1304T, I1706V, A1073V, G1662S, L1092P, I962V, S509P, I206M and R90W or an amino acid encoded by a SNP selected from the group consisting of rs6801957, rs6795970, rs10428132, rs12632942, rs57326399, rs7630989, rs74717885 and rs144270136; optionally selected from the group consisting of L554P, A1304T, I1706V and G1662S (eg, when the condition is neuropathic pain);
   wherein (i) the ligand comprises a human gamma-2 heavy chain constant region that comprises an amino acid selected from the group consisting of a Pro at position 72 shown in SEQ ID NO: 6, an Asn at position 75 shown in SEQ ID NO: 6, a Phe at position 76 shown in SEQ ID NO: 6, a Val at position 161 shown in SEQ ID NO: 6 and an Ala at position 257 shown in SEQ ID NO: 6 and wherein said human comprises (i) an IGHG2*01 human heavy chain constant region gene segment, or the human expresses antibodies comprising human gamma-2 heavy chain constant regions comprising said selected Pro at position 72 shown in SEQ ID NO: 6, Asn at position 75 shown in SEQ ID NO: 6, Phe at position 76 shown in SEQ ID NO: 6, Val at position 161 shown in SEQ ID NO: 6 or Ala at position 257 shown in SEQ ID NO: 6; and
   wherein (ii) said human comprises a nucleotide sequence encoding said Nav1.8 protein comprising said amino acid selected from the group consisting of L554P, A1304T, I1706V, A1073V, G1662S, L1092P, I962V, S509P, I206M and R90W or an amino acid encoded by a SNP selected from the group consisting of rs6801957, rs6795970, rs10428132, rs12632942, rs57326399, rs7630989, rs74717885 and rs144270136; optionally selected from the group consisting of L554P, A1304T, I1706V and G1662S (eg, when the condition is neuropathic pain).

In an alternative, clause 1 provides:—

A method of targeting Nav1.8 in a human, the method comprising administering to said human a ligand (eg, an antibody or antibody fragment) that specifically binds a human Nav1.8 protein that comprises an amino acid selected from the group consisting of L554P, A1304T, I1706V, A1073V, G1662S, L1092P, I962V, S509P, I206M and R90W or an amino acid encoded by a SNP selected from the group consisting of rs6801957, rs6795970, rs10428132, rs12632942, rs57326399, rs7630989, rs74717885 and rs144270136; optionally selected from the group consisting of L554P, A1304T, I1706V and G1662S (eg, when the condition is neuropathic pain); wherein (i) the ligand comprises a human gamma-2 heavy chain constant region that comprises an amino acid selected from the group consisting of a Pro at position 72 shown in SEQ ID NO: 6, an Asn at position 75 shown in SEQ ID NO: 6, a Phe at position 76 shown in SEQ ID NO: 6, a Val at position 161 shown in SEQ ID NO: 6 and an Ala at position 257 shown in SEQ ID NO: 6 and wherein said human comprises (i) an IGHG2*01 human heavy chain constant region gene segment, or the human expresses antibodies comprising human gamma-2 heavy chain constant regions comprising said selected Pro at position 72 shown in SEQ ID NO: 6, Asn at position 75 shown in SEQ ID NO: 6, Phe at position 76 shown in SEQ ID NO: 6, Val at position 161 shown in SEQ ID NO: 6 or Ala at position 257 shown in SEQ ID NO: 6; and wherein (ii) said human comprises a nucleotide sequence encoding said Nav1.8 protein comprising said amino acid selected from the group consisting of L554P, A1304T, I1706V, A1073V, G1662S, L1092P, I962V, S509P, I206M and R90W or an amino acid encoded by a SNP selected from the group consisting of rs6801957, rs6795970, rs10428132, rs12632942, rs57326399, rs7630989, rs74717885 and rs144270136; optionally selected from the group consisting of L554P, A1304T, I1706V and G1662S (eg, when the condition is neuropathic pain).

In an example, the human is suffering from or at risk of a Nav1.8-mediated disease or condition.

In an example, the method treats or reduces the risk of a Nav1.8-mediated disease or condition in the human.

2. The method of any preceding clause, wherein said amino acid is selected from the group consisting of L554P, A1304T, I1706V and G1662S; optionally wherein said disease or condition is a pain disease or condition, eg, inflammatory pain or neuropathic pain, (eg, SFN).
3. The method of any preceding clause, wherein said amino acid is selected from the group consisting of 2884A>G and 3218C>T; optionally wherein said disease or condition is pain or is selected from dyspepsia, EPS, DPS and gastric pain.
4. The method of any preceding clause, wherein said amino acid is encoded by a SNP selected from the group consisting of rs6801957, rs6795970 and rs10428132; optionally wherein said disease or condition is selected from the group consisting of Brugada syndrome, cardiac pain, cardiac arrhythmia, heart block, ventricular fibrillation and atrial fibrillation.

5. The method of any preceding clause, wherein the constant region gene segment comprised by said human is a germ-line gene segment.
6. The method of any preceding clause comprising, before said administering, selecting a human comprising said nucleotide sequence of (ii), wherein the human is the human of clause 1.
7. The method of any preceding clause, wherein the human has been determined to comprise the nucleotide sequence that encodes a Nav1.8 protein comprising said selected amino acid and/or a Nav1.8 protein comprising said selected amino acid.
8. The method of any preceding clause, comprising the step of determining that the human comprises (a) the nucleotide sequence that encodes a Nav1.8 protein comprising said selected amino acid and/or (b) a Nav1.8 protein comprising said selected amino acid, optionally, wherein the determining step is performed before administration of the antibody to the human.
9. The method of clause 8, wherein the step of determining comprises assaying a biological sample from the human for a nucleotide sequence encoding a Nav1.8 protein comprising said selected amino acid.
10. The method of clause 9, wherein the assaying comprises contacting the biological sample with at least one oligonucleotide probe comprising a sequence of at least 10 contiguous nucleotides of a nucleotide sequence encoding a Nav1.8 protein comprising said selected amino acid or comprising an antisense sequence of said contiguous nucleotides, wherein said sequence of contiguous nucleotides comprises a nucleotide sequence encoding said selected amino acid, thereby forming a complex when at least one nucleotide sequence encoding the Nav1.8 protein comprising said selected amino acid is present; and
detecting the presence or absence of the complex, wherein detecting the presence of the complex determines that the human comprises the Nav1.8 protein comprising said selected amino acid.
11. The method of clause 9, wherein the assaying comprises nucleic acid amplification and optionally one or more methods selected from sequencing, next generation sequencing, nucleic acid hybridization, and allele-specific amplification and/or wherein the assaying is performed in a multiplex format.
12. The method of clause 9 or 11, wherein said biological sample comprises serum, blood, feces, tissue, a cell, urine and/or saliva of said human.
13. The method of any preceding clause, wherein said human is indicated as heterozygous for a nucleotide sequence encoding the Nav1.8 protein comprising said selected amino acid, optionally, wherein said human is further indicated as comprising the nucleotide sequence of SEQ ID NO: 136 or said human is indicated as homozygous for a nucleotide sequence encoding the Nav1.8 protein comprising said selected amino acid.
14. The method of any preceding clause, wherein said human is or has been further determined to be substantially resistant to a pain or itching treatment.
15. The method of any preceding clause, wherein said human is receiving or has received a pain or itching treatment or has reduced responsiveness to a pain or itching treatment.
16. The method of any preceding clause, wherein said disease or condition is a pain or itching disease or condition.
17. The method of any preceding clause, wherein said disease or condition is neuropathic pain.
18. The method of any preceding clause, wherein said human has been diagnosed with at least one condition recited in clause 16 or 17.
19. The method of any preceding clause, wherein said antibody or antibody fragment treats or reduces the risk in said human of a condition recited in clause 16 or 17.
20. The method of any preceding clause, wherein the nucleotide sequence comprises one or more SNPs selected from the group consisting rs138404783, rs6801957, rs6795970, rs10428132, rs12632942, rs57326399, rs7630989, rs74717885 and rs144270136.
21. The method of any preceding clause, wherein said ligand (eg, antibody or antibody fragment) is administered by inhaled, intravenous or subcutaneous administration and/or is comprised in an inhalable or injectable preparation.
22. The method of any preceding clause, wherein the human gamma-2 heavy chain constant region of the ligand comprises IGHG2*01 amino acid sequence or an ADCC inactivated version thereof.

Ligands with Gamma-2 Constant Region Tailoring

1. A ligand (eg, an antibody or antibody fragment) for use in a method of treating or reducing the risk of a Nav1.8-mediated disease or condition (eg, pain) in a human in need thereof, wherein the ligand specifically binds a human Nav1.8 protein that comprises an amino acid selected from the group consisting of L554P, A1304T, I1706V, A1073V, G1662S, L1092P, I962V, S509P, I206M and R90W or an amino acid encoded by a SNP selected from the group consisting of rs6801957, rs6795970, rs10428132, rs12632942, rs57326399, rs7630989, rs74717885 and rs144270136; optionally selected from the group consisting of L554P, A1304T, I1706V and G1662S (eg, when the condition is neuropathic pain);
wherein (i) the ligand comprises a human gamma-2 heavy chain constant region that comprises an amino acid selected from the group consisting of a Pro at position 72 shown in SEQ ID NO: 6, an Asn at position 75 shown in SEQ ID NO: 6, a Phe at position 76 shown in SEQ ID NO: 6, a Val at position 161 shown in SEQ ID NO: 6 and an Ala at position 257 shown in SEQ ID NO: 6 and wherein said human comprises (i) an IGHG2*01 human heavy chain constant region gene segment, or the human expresses antibodies comprising human gamma-2 heavy chain constant regions comprising said selected Pro at position 72 shown in SEQ ID NO: 6, Asn at position 75 shown in SEQ ID NO: 6, Phe at position 76 shown in SEQ ID NO: 6, Val at position 161 shown in SEQ ID NO: 6 or Ala at position 257 shown in SEQ ID NO: 6; and
wherein (ii) said human comprises a nucleotide sequence encoding said Nav1.8 protein comprising said amino acid selected from the group consisting of L554P, A1304T, I1706V, A1073V, G1662S, L1092P, I962V, S509P, I206M and R90W or an amino acid encoded by a SNP selected from the group consisting of rs6801957, rs6795970, rs10428132, rs12632942, rs57326399, rs7630989, rs74717885 and rs144270136; optionally selected from the group consisting of L554P, A1304T, I1706V and G1662S (eg, when the condition is neuropathic pain).

In an alternative, paragraph 1 provides:—

A ligand (eg, an antibody or antibody fragment) for use in a method of targeting Nav1.8 in a human, wherein the ligand specifically binds a human Nav1.8 protein that comprises an amino acid selected from the group consisting of L554P, A1304T, I1706V, A1073V, G1662S, L1092P, I962V, S509P, I206M and R90W or an amino acid encoded by a SNP selected from the group consisting of rs6801957, rs6795970, rs10428132, rs12632942, rs57326399, rs7630989, rs74717885 and rs144270136; optionally selected from the group consisting of L554P, A1304T, I1706V and G1662S (eg, when the condition is neuropathic pain);
wherein (i) the ligand comprises a human gamma-2 heavy chain constant region that comprises an amino acid selected from the group consisting of a Pro at position 72 shown in SEQ ID NO: 6, an Asn at position 75 shown in SEQ ID NO: 6, a Phe at position 76 shown in SEQ ID NO: 6, a Val at position 161 shown in SEQ ID NO: 6 and an Ala at position 257 shown in SEQ ID NO: 6 and wherein said human comprises (i) an IGHG2*01 human heavy chain constant region gene segment, or the human expresses antibodies comprising human gamma-2 heavy chain constant regions comprising said selected Pro at position 72 shown in SEQ ID NO: 6, Asn at position 75 shown in SEQ ID NO: 6, Phe at position 76 shown in SEQ ID NO: 6, Val at position 161 shown in SEQ ID NO: 6 or Ala at position 257 shown in SEQ ID NO: 6; and
wherein (ii) said human comprises a nucleotide sequence encoding said Nav1.8 protein comprising said amino acid selected from the group consisting of L554P, A1304T, I1706V, A1073V, G1662S, L1092P, I962V, 5509P, I206M and R90W or an amino acid encoded by a SNP selected from the group consisting of rs6801957, rs6795970, rs10428132, rs12632942, rs57326399, rs7630989, rs74717885 and rs144270136; optionally selected from the group consisting of L554P, A1304T, I1706V and G1662S (eg, when the condition is neuropathic pain).

In an example, the human is suffering from or at risk of a Nav1.8-mediated disease or condition.

In an example, the method treats or reduces the risk of a Nav1.8-mediated disease or condition in the human.

2. The ligand of any preceding clause, wherein said amino acid is selected from the group consisting of L554P, A1304T, I1706V and G1662S; optionally wherein said disease or condition is a pain disease or condition, eg, inflammatory pain or neuropathic pain, (eg, SFN).

3. The ligand of any preceding clause, wherein said amino acid is selected from the group consisting of 2884A>G and 3218C>T; optionally wherein said disease or condition is pain or is selected from dyspepsia, EPS, DPS and gastric pain.

4. The ligand of any preceding clause, wherein said amino acid is encoded by a SNP selected from the group consisting of rs6801957, rs6795970 and rs10428132; optionally wherein said disease or condition is selected from the group consisting of Brugada syndrome, cardiac pain, cardiac arrhythmia, heart block, ventricular fibrillation and atrial fibrillation.

5. The ligand of any preceding clause, wherein the constant region gene segment comprised by said human is a germline gene segment.

6. The ligand of any preceding clause said method comprising, before said administering, selecting a human comprising said nucleotide sequence of (ii), wherein the human is the human of clause 1.

7. The ligand of any preceding clause, wherein the human has been determined to comprise the nucleotide sequence that encodes a Nav1.8 protein comprising said selected amino acid selected and/or a Nav1.8 protein comprising said selected amino acid.

8. The ligand of any preceding clause, said method comprising the step of determining that the human comprises (a) the nucleotide sequence that encodes a Nav1.8 protein comprising said selected amino acid and/or (b) a Nav1.8 protein comprising said selected amino acid, optionally, wherein the determining step is performed before administration of the antibody to the human.

9. The ligand of clause 8, wherein the step of determining comprises assaying a biological sample from the human for a nucleotide sequence encoding a Nav1.8 protein comprising said selected amino acid.

10. The ligand of clause 9, wherein the assaying comprises contacting the biological sample with at least one oligonucleotide probe comprising a sequence of at least 10 contiguous nucleotides of a nucleotide sequence encoding a Nav1.8 protein comprising said selected amino acid or comprising an antisense sequence of said contiguous nucleotides, wherein said sequence of contiguous nucleotides comprises a nucleotide sequence encoding said selected amino acid, thereby forming a complex when at least one nucleotide sequence encoding the Nav1.8 protein comprising said selected amino acid is present; and
detecting the presence or absence of the complex, wherein detecting the presence of the complex determines that the human comprises the Nav1.8 protein comprising said selected amino acid.

11. The ligand of clause 9, wherein the assaying comprises nucleic acid amplification and optionally one or more methods selected from sequencing, next generation sequencing, nucleic acid hybridization, and allele-specific amplification and/or wherein the assaying is performed in a multiplex format.

12. The ligand of clause 9 or 11, wherein said biological sample comprises serum, blood, feces, tissue, a cell, urine and/or saliva of said human.

13. The ligand of any preceding clause, wherein said human is indicated as heterozygous for a nucleotide sequence encoding the Nav1.8 protein comprising said selected amino acid, optionally, wherein said human is further indicated as comprising the nucleotide sequence of SEQ ID NO: 136, or said human is indicated as homozygous for a nucleotide sequence encoding the Nav1.8 protein comprising said selected amino acid.

14. The ligand of any preceding clause, wherein said human is or has been further determined to be substantially resistant to a pain or itching treatment.

15. The ligand of any preceding clause, wherein said human is receiving or has received a pain or itching treatment or has reduced responsiveness to a pain or itching treatment.

16. The ligand of any preceding clause, wherein said disease or condition is a pain or itching disease or condition.

17. The ligand of any preceding clause, wherein said disease or condition is neuropathic pain.

18. The ligand of any preceding clause, wherein said human has been diagnosed with at least one condition recited in clause 16 or 17.

19. The ligand of any preceding clause, wherein said antibody or antibody fragment treats or reduces the risk in said human of a condition recited in clause 16 or 17.

20. The ligand of any preceding clause, wherein the nucleotide sequence comprises one or more SNPs selected from the group consisting of rs138404783, rs6801957, rs6795970, rs10428132, rs12632942, rs57326399, rs7630989, rs74717885 and rs144270136.

21. The ligand of any preceding clause, wherein said ligand (eg, antibody or antibody fragment) is for inhaled, intravenous or subcutaneous administration and/or is comprised in an inhalable or injectable preparation.

22. The ligand of any preceding clause, wherein the human gamma-2 heavy chain constant region of the ligand comprises IGHG2*01 amino acid sequence or an ADCC inactivated version thereof.

In any embodiment or example of the Nav1.8-focused invention, the method optionally reduces a symptom of neuropathic pain or inflammatory pain; or optionally the ligand is for reducing a symptom of neuropathic pain or inflammatory pain.

In any embodiment or example of the Nav1.8-focused invention said selected amino acid may be regarded as a mutation in SEQ ID NO: 135.

In an example, the human is suffering from or at risk of a Nav1.8-mediated disease or condition. In an example, the method treats or reduces the risk of a Nav1.8-mediated disease or condition in the human.

Example 10

Nav1.9 (SCN11A; NaN; SCN12A; SNS-2)

Nav1.9 (Sodium channel, voltage-gated, type XI, alpha subunit) is a voltage-gated sodium ion channel protein which in humans is encoded by the SCN11A gene (OMIM: 604385). Nav1.9 has high expression levels in peripheral sensory neurons and is thought to carry the NaN current, a persistent and tetrodrotoxin (TTX)-resistant voltage-gated Na Current, involved in pain-related signalling. Nav1.9 is found within small sensory neurons (<30 μm diameter) of dorsal root ganglia (DRG) and trigeminal ganglia. Nav1.9 is relatively resistant to TTX, but has kinetic properties distinct from the similarly TTX-resistant Nav1.8, producing a persistent current with an activation potential of –70 mV, close to the resting membrane potential, where it may set the threshold for activation. A gain-of-function mutation of SCN11A was reported to be linked to congenital insensitivity to pain (Leipold et al 2013), familial episodic pain (Zhang et al 2013) and painful peripheral neuropathy (Huang et al 2014).

Human Nav1.9 polymorphism has been observed. Reference is made to the following, the disclosures of which are incorporated herein by reference in their entirety:—
1. Waxman S G et al, Lancet Neurol. 2014 November; 13(11): 1152-60. doi: 10.1016/51474-4422(14)70150-4; "Sodium channel genes in pain-related disorders: phenotype-genotype associations and recommendations for clinical use".
2. Hoeijmakers J G et al, "Neurosci Lett. 2014 Dec. 31. pii: 50304-3940(14)01009-X. doi: 10.1016/j.neulet.2014.12.056; "Painful peripheral neuropathy and sodium channel mutations".
3. Huang J et al, Brain. 2014 June; 137(Pt 6):1627-42. doi: 10.1093/brain/awu079. Epub 2014 Apr. 27; "Gain-of-function mutations in sodium channel Na(v)1.9 in painful neuropathy".
4. Leipold E et al, Nat Genet. 2013 November; 45(11):1399-404. doi: 10.1038/ng.2767. Epub 2013 Sep. 15; "A de novo gain-of-function mutation in SCN11A causes loss of pain perception".
5. Zhang X Y et al, Am J Hum Genet. 2013 Nov. 7; 93(5): 957-66. doi: 10.1016/j.ajhg.2013.09.016. Epub 2013 Oct. 24; "Gain-of-function mutations in SCN11A cause familial episodic pain".
6. Bennett D L, Brain. 2014 June; 137(Pt 6):1574-6. doi: 10.1093/brain/awu105. Epub 2014 Apr. 27; "Voltage-gated sodium channel mutations and painful neuropathy: Na(v)1.9 joins the family".

In an example, the invention provides a method of treating or reducing the risk of a Nav1.9-mediated disease or condition in a human in need thereof, the method comprising administering to said human a ligand (eg, an antibody or antibody fragment) that specifically binds a human Nav1.9 protein. The invention also provides a corresponding ligand.

The present invention provides anti-Nav1.9 ligands; and Nav1.9-binding or targeting ligands as described herein. The ligands have a variety of utilities. Some of the ligands, for instance, are useful in specific binding assays, for genotyping or phenotyping humans, affinity purification of Nav1.9, in particular human Nav1.9 or its ligands and in screening assays to identify other antagonists of Nav1.9 activity. Some of the ligands of the invention are useful for inhibiting Nav1.9-mediated activities.

Anti-Nav1.9 ligands (eg, antibodies and anti-sense RNA) have been developed based on targeting and neutralising so-called "wild-type" human Nav1.9, which is a commonly-occurring form (see, eg, SEQ ID NO: 137). While such ligand may be useful for human patients harbouring this form of human Nav1.9, the inventor considered it useful to investigate the possibility of targeting rarer—but still naturally-occurring—forms of Nav1.9 amongst human populations. In this way, the inventor arrived at insight into the natural occurrences and distributions of rarer human Nav1.9 forms that can serve as useful targets (at the protein or nucleic acid level) for human treatment, prophylaxis and diagnosis pertinent to diseases and conditions mediated or associated with Nav1.9 activity. This particularly provides for tailored therapies, prophylaxis and diagnosis in humans that are devoid of the common Nav1.9 gene or protein.

The skilled person will know that SNPs or other changes that translate into amino acid variation can cause variability in activity and/or conformation of human targets to be addressed. This has spawned great interest in personalized medicine where genotyping and knowledge of protein and nucleotide variability is used to more effectively tailor medicines and diagnosis of patients. The invention, therefore, provides for tailored pharmaceuticals and testing that specifically addresses rarer Nav1.9 polymorphic variant forms. Such forms or "alleles" (at the nucleotide level), comprise one or more changes at the nucleotide and amino acid levels from the corresponding common form nucleotide and amino acids sequences, ie, there are one or more non-synonymous (aka "missense") changes at the nucleotide level that translate into one or more corresponding changes in the protein target in humans.

Furthermore, the inventor surprisingly realised that rarer natural forms, although present in humans at much lower frequencies than the common form, nevertheless are represented in multiple and ethnically-diverse human populations and usually with many human examples per represented ethnic population. Thus, the inventor realised that targeting rarer forms would provide for effective treatment, prophylaxis or diagnosis across many human ethnic populations, thereby extending the utility of the present invention.

With this realisation, the inventor saw that there is significant industrial and medical application for the invention in terms of guiding the choice of anti-Nav1.9 ligand for administration to human patients for therapy and/or prophylaxis of Nav1.9-mediated or associated diseases or conditions. In this way, the patient receives drugs and ligands that are tailored to their needs—as determined by the patient's genetic or phenotypic makeup. Hand-in-hand with this, the invention provides for the genotyping and/or phenotyping of patients in connection with such treatment, thereby allowing a proper match of drug to patient. This increases the chances of medical efficacy, reduces the likelihood of inferior treatment using drugs or ligands that are not matched to the patient (eg, poor efficacy and/or side-effects) and avoids pharmaceutical misprescription and waste.

In developing this thinking, in this non-limiting example a set of human Nav1.9 variants can be determined on the basis of the following criteria, these being criteria that the inventor realised would provide for useful medical drugs and diagnostics to tailored need in the human population. The inventor selected some variants having at least 3 of the 4 following criteria:—

Naturally-occurring human Nav1.9 variation having a cumulative human allele frequency of 35% or less;

Naturally-occurring human Nav1.9 variation having a total human genotype frequency of about 50% or less;

Naturally-occurring human Nav1.9 variation found in many different human ethnic populations (using the standard categorisation of the 1000 Genomes Project; see Table 2 below); and Naturally-occurring human Nav1.9 variation found in many individuals distributed across such many different ethnic populations.

The selection can include, as an additional or alternative consideration, selection for nucleotide variation that produced amino acid variation in corresponding Nav1.9 forms (ie, non-synonymous variations), as opposed to silent variations that do not alter amino acid residues in the target protein.

Variants can also be sourced from Ensembl, 1000 Genomes database or the literature.

The inventor identified variants listed in Table 26 below.

TABLE 26

| | | | | | | |
|---|---|---|---|---|---|---|
| | | Nav1.9 - Human Polymorphism & SNPs | | | | |
| SNP/VARIANT | CHROMOSOMAL LOCATION (FORWARD STRAND) | NUCLEOTIDE CHANGE | AMINO ACID CHANGE | AMINO ACID POSITION | CUMULATIVE FREQUENCY[1] | EXAMPLE CONDITIONS |
| | | 1142T > C | I381T | 381 | | SFN<br>Numbness (eg, in feet)<br>Tingling (eg, in legs)<br>Cramps (eg, in hands, feet or legs)<br>Joint pain<br>Decreased vibration sensitivity<br>Abnormal warmth or cold sensation |
| | | | K419N | 419 | | SFN<br>Numbness (eg, in feet)<br>Tingling (eg, in legs)<br>Cramps (eg, in hands, feet or legs)<br>Joint pain<br>Decreased vibration sensitivity<br>Abnormal warmth or cold sensation |
| | | | A582T | 582 | | SFN<br>Numbness (eg, in feet)<br>Tingling (eg, in legs)<br>Cramps (eg, in hands, feet or legs)<br>Joint pain<br>Decreased vibration sensitivity<br>Abnormal warmth or cold sensation |
| | | | A681D | 681 | | SFN<br>Numbness (eg, in feet)<br>Tingling (eg, in legs)<br>Cramps (eg, in hands, feet or legs)<br>Joint pain<br>Decreased vibration sensitivity<br>Abnormal warmth or cold sensation |
| | | | A842P | 842 | | SFN<br>Numbness (eg, in feet)<br>Tingling (eg, in legs)<br>Cramps (eg, in hands, feet or legs)<br>Joint pain<br>Decreased vibration sensitivity |

TABLE 26-continued

Nav1.9 - Human Polymorphism & SNPs

| SNP/VARIANT | CHROMOSOMAL LOCATION (FORWARD STRAND) | NUCLEOTIDE CHANGE | AMINO ACID CHANGE | AMINO ACID POSITION | CUMULATIVE FREQUENCY[1] | EXAMPLE CONDITIONS |
|---|---|---|---|---|---|---|
| | | 3473T > C | L1158P | 1158 | | Abnormal warmth or cold sensation<br>SFN<br>Numbness (eg, in feet)<br>Tingling (eg, in legs)<br>Cramps (eg, in hands, feet or legs)<br>Joint pain<br>Decreased vibration sensitivity |
| | | | F1689L | 1689 | | Abnormal warmth or cold sensation<br>SFN<br>Numbness (eg, in feet)<br>Tingling (eg, in legs)<br>Cramps (eg, in hands, feet or legs)<br>Joint pain<br>Decreased vibration sensitivity |
| | | 2432T > C | L811P | 811 | | Abnormal warmth or cold sensation<br>Pain insensitivity |
| | | 673C > T | R225C | 225 | | Abnormal warmth or cold sensation<br>Pain<br>Episodic pain (eg, familial episodic pain) |
| | | 2423C > G | A808G | 808 | | Pain<br>Episodic pain (eg, familial episodic pain) |
| rs33985936* | 3:38894643 | C > T | V909I | 909 | 0.165 | A pain condition |
| rs78812474** | 3:38950107 | G > T | R86G | 86 | 0.061 | A pain condition |
| rs72869687*** | 3:38847244 | G > A | T1609I | 1609 | 0.054 | A pain condition |
| rs13059805**** | 3:38907980 | C > T | G481E | 481 | 0.013 | A pain condition |

SFN = small fibre neuropathy or pain associated with small fibre neuropathy, SFN with large fibre involvement

[1]According to Ensembl, dbSNP

*rs33985936 is present in humans at an average cumulative frequency of 17% according to the 1000 Genomes Phase I database, but is higher in AMR, EUR, MXL, PUR, CEU, FIN, GBR, IBS and TSI populations; thus in an embodiment, in the present invention involving Nav1.9 the human is of AMR ancestry, eg, of MXL or PUR ancestry; or of EUR ancestry, eg, of CEU, FIN, GBR, IBS or TSI ancestry.

**rs78812474 is present in humans at an average cumulative frequency of 6% according to the 1000 Genomes Phase I database, but is higher in AFR, LWK, YRI, MXL and GBR populations; thus in an embodiment, in the present invention involving Nav1.9 the human is of AFR ancestry, eg, of LWK or YRI ancestry; or of MXL or GBR ancestry.

***rs72869687 is present in humans at an average cumulative frequency of 5% according to the 1000 Genomes Phase I database, but is higher in AFR, ASN, ASW, LWK, YRI, CHB, CHS and JPT populations; thus in an embodiment, in the present invention involving Nav1.9 the human is of AFR ancestry, eg, of ASW, LWK or YRI ancestry; or of ASN ancestry, eg, of CHB, CHS or JPT ancestry.

****rs13059805 is present in humans at an average cumulative frequency of 1% according to the 1000 Genomes Phase I database, but is higher in AMR, EUR, CLM, MXL, CEU, FIN and GBR populations; thus in an embodiment, in the present invention involving Nav1.9 the human is of AMR, EUR, CLM, MXL, CEU, FIN or GBR ancestry.

In an embodiment, variations are with reference to transcript ENST00000302328 (the sequence of this transcript being incorporated herein in its entirety).

Optionally for any mutation, the condition is a condition listed in Table 26.

In an embodiment, the human comprises a SNP selected from the SNPs in column 1 of Table 26; optionally also the ligand specifically binds a human Nav1.9 encoded by a nucleotide sequence comprising said SNP.

In an embodiment, the human comprises a Nav1.9 amino acid variation selected from the variations in column 4 of Table 26; optionally also the ligand specifically binds a human Nav1.9 comprising said variation.

In an example, the invention provides a method of treating or reducing the risk of a Nav1.9-mediated disease or condition in a human in need thereof, the method comprising administering to said human a ligand (eg, an antibody or antibody fragment) that specifically binds a human Nav1.9 protein that comprises an amino acid selected from the group consisting of I381T, K419N, A582T, A681D, A842P, L1158P, F1689L, L811P, R225C, A808G, V909I, R86G, T1609I and G481E. These amino acid variations are found in naturally-occurring Nav1.9 variants in humans.

Said human comprises a nucleotide sequence encoding a Nav1.9 protein comprising said selected amino acid.

Optionally in any embodiment of the Nav1.9 invention said amino acid is selected from the group consisting of I381T, K419N, A582T, A681D, A842P, L1158P, F1689L, L811P and R225C, eg, wherein the condition is a pain condition.

Optionally in any embodiment of the Nav1.9 invention said amino acid is selected from the group consisting of I381T, K419N, A582T, A681D, A842P, L1158P and F1689L, eg, wherein the condition is SFN, numbness (eg, in feet), tingling (eg, in legs), cramps (eg, in hands, feet or legs), joint pain, decreased vibration sensitivity, or abnormal warmth or cold sensation.

Optionally in any embodiment of the Nav1.9 invention said amino acid is selected from the group consisting of A808G and R225C, eg, wherein the condition is a corresponding condition listed in Table 26.

Alternatively, in any embodiment of the Nav1.9 invention the amino acid is encoded by a SNP selected from the group consisting of rs33985936, rs78812474, rs72869687 and rs13059805, eg, wherein the condition is a corresponding condition listed in Table 26.

The disease or condition is, for example, any disease or condition described above in the Example relating to Nav1.7 and the disclosure of such diseases and conditions are hereby also imported into this example to provide for possible combination of the present invention relating to Nav1.9 (eg, for use in one or more claims herein). In one embodiment, the condition is a condition listed in Table 26 or a symptom of such a condition. In an example, the condition is pain or a symptom of pain, eg, a symptom of neuropathic pain. In an example, the condition is selected from the group consisting of paroxysmal pain (eg, of hands and/or feet), hand pain, foot pain, limb pain (eg, leg pain), cramp (eg, foot cramp or leg cramp), tingling (e, foot, hand or leg tingling) and pain associated with clothing contact with the human. In an example, the condition is an abnormal threshold for warmth or cold sensation (eg, in a foot or feet). In an example, the condition is joint pain. In an example, the condition is dry eye sensation, diarrhea, urinary condition, heart palpitations or dizziness. In an example, the condition is insensitivity to pain. In an example, the condition is episodic pain (eg, familial episodic pain).

In one embodiment, the pain is chronic pain.

In one embodiment, the pain is neuropathic pain, eg, chronic neuropathic pain, eg, peripheral neuropathic pain. For example, the pain is painful diabetic neuropathy (PDN), post-herpetic neuropathy (PHN) or trigeminal neuralgia (TN).

In an example, the pain is spinal cord injury pain, multiple sclerosis pain, phantom limb pain, post-stroke pain, chronic back pain, osteoarthritis pain, cancer-associated pain or HIV-associated pain.

In one embodiment, the pain is inflammatory pain, eg, chronic inflammatory pain.

In an example, the ligand of the invention comprises an anti-human Nav1.9 binding site, wherein the binding site is a human or humanized binding site, eg, the binding site comprises or consists of a human or humanized antibody variable domain or plurality of variable domains (eg, human VH/VL binding site(s)). Additionally or alternatively, the ligand comprises one or more human antibody constant regions (eg, a human antibody CH1, CH2, CH3 (or all of these) or Fc). In an example, the ligand is an antibody that comprises human or humanized variable regions and human constant regions (eg, bearing one or more mutations to enhance or dampen Fc function in a human patient).

An example provides a ligand (eg, an antibody or antibody fragment) for treating or reducing the risk of a Nav1.9-mediated disease or condition in a human in need thereof, the method comprising administering to said human said ligand, wherein the ligand specifically binds a human Nav1.9 protein that comprises an amino acid selected from the group consisting of I381T, K419N, A582T, A681D, A842P, L1158P, F1689L, L811P, R225C, A808G, V909I, R86G, T1609I and G481E. Said human comprises a nucleotide sequence encoding a Nav1.9 protein comprising said selected amino acid.

In an example, the invention provides a method of targeting Nav1.9 in a human, the method comprising administering to said human a ligand (eg, an antibody or antibody fragment) that specifically binds a human Nav1.9 protein that comprises an amino acid selected from the group consisting of I381T, K419N, A582T, A681D, A842P, L1158P, F1689L, L811P, R225C, A808G, V909I, R86G, T1609I and G481E. Said human comprises a nucleotide sequence encoding a Nav1.9 protein comprising said selected amino acid. In an example, the human is suffering from or at risk of a Nav1.9-mediated disease or condition. In an example, the method treats or reduces the risk of a Nav1.9-mediated disease or condition in the human.

An example also provides a ligand (eg, an antibody or antibody fragment) for targeting Nav1.9 in a human, the method comprising administering to said human said ligand, wherein the ligand specifically binds a human Nav1.9 protein that comprises an amino acid selected from the group consisting of I381T, K419N, A582T, A681D, A842P, L1158P, F1689L, L811P, R225C, A808G, V909I, R86G, T1609I and G481E. Said human comprises a nucleotide sequence encoding a (eg, said) Nav1.9 protein comprising said selected amino acid. In an example, the human is suffering from or at risk of a Nav1.9-mediated disease or condition. In an example, the method treats or reduces the risk of a Nav1.9-mediated disease or condition in the human.

In an embodiment, (i) the antibody or fragment comprises a VH domain derived from the recombination of a human VH segment, a human D gene segment and a human JH segment, the human VH segment encoding the framework 1 of SEQ ID NO: 40 and wherein said human comprises a VH gene segment encoding the framework 1 of SEQ ID NO: 40, or the human expresses VH domains that comprise the framework 1 of SEQ ID NO: 40; and wherein (ii) said human comprises a nucleotide sequence encoding said Nav1.9 protein comprising said amino acid selected from the group consisting of I381T, K419N, A582T, A681D, A842P, L1158P, F1689L, L811P, R225C, A808G, V909I, R86G, T1609I and G481E.

Additionally or alternatively, in an embodiment, (i) the antibody or fragment comprises a human gamma-4 heavy chain constant region that comprises a Leu at position 189 shown in SEQ ID NO: 73 or an Arg at position 289 shown in SEQ ID NO: 73 and wherein said human comprises an IGHG4*01 human heavy chain constant region gene segment, or the human expresses antibodies comprising human gamma-4 heavy chain constant regions comprising a Leu at position 189 shown in SEQ ID NO: 73 or an Arg at position 289 shown in SEQ ID NO: 73; and wherein (ii) said human comprises a nucleotide sequence encoding said Nav1.9 protein comprising said amino acid selected from the group consisting of I381T, K419N, A582T, A681D, A842P, L1158P, F1689L, L811P, R225C, A808G, V909I, R86G, T1609I and G481E.

In an example, the ligand, antibody or fragment is for treating or reducing the risk of (or treats or reduces the risk of) pain or itching, optionally wherein the antibody is a humanized mouse or Camelid (eg, llama or camel) antibody.

In a specific embodiment, the anti-Nav1.9 ligand, antibody or fragment also specifically binds to another Nav selected from Nav1.1-1.8, eg, it specifically binds to Nav1.7 or 1.8.

In a specific embodiment, the anti-Nav1.9 ligand, antibody or fragment of the present invention comprises an Fc region as per the disclosure in the Nav1.7 example above.

The ligand, antibody or fragment according to the invention is for treating or preventing or reducing the risk of (or treats or prevents or reduces the risk of), for example, any disease or condition disclosed in WO2011/051351 or U.S.

Pat. No. 7,582,745, the disclosures of which diseases and conditions are incorporated herein by reference for potential inclusion in one or more claims herein. Guidance on obtaining and testing antibodies can also be found in that PCT application.

Further encompassed by the invention is the use of the ligand, antibody or fragment in the manufacture of a medicament for use to attenuate or inhibit a Nav1.9-mediated disease or disorder in a human. Nav1.9-mediated or related disorders which are treated by the ligand, antibody or fragment of the invention include, for example, a pain or itching disease or condition.

Thus, a ligand, antibody or fragment of the invention is useful as a therapeutic agent in the treatment of a condition involving Nav1.9 expression and/or activity. One embodiment, among others, is a method of treatment comprising administering an effective amount of a ligand, antibody or fragment of the invention to a patient in need thereof, wherein functional consequences of Nav1.9 activation are decreased. Another embodiment, among others, is a method of treatment comprising (i) identifying a patient demonstrating Nav1.9 expression or activity, and (ii) administering an effective amount of a ligand, antibody or fragment of the invention to the patient, wherein a functional consequence of Nav1.9 activation are attenuated. An effective amount according to the invention is an amount that modulates (e.g. decreases) the functional consequences of Nav1.9 activation so as to modulate (e.g. decrease or lessen) the severity of at least one symptom of the particular disease or disorder being treated, but not necessarily cure the disease or disorder. Accordingly, one embodiment of the invention is a method of treating or reducing the severity of at least one symptom of any of the disorders referred to herein, comprising administering to a patient in need thereof an effective amount of one or more ligands, antibodies or fragments of the present invention alone or in a combined therapeutic regimen with another appropriate medicament known in the art or described herein such that the severity of at least one symptom of any of the disorders is reduced. Another embodiment of the invention, among others, is a method of antagonizing at least one effect of Nav1.9 comprising contacting with or administering an effective amount of one or more ligands, antibodies or fragments of the present invention such that said at least one effect of Nav1.9 is antagonized, e.g. the ability of Nav1.9 to form an ion channel, such as a sodium channel.

Tailoring Antibodies to Rarer Nav1.9 Variant Profile

As outlined herein (for example, in the context of PCSK9 in Example 1 or in the context of the Nav1.7 Example herein), the invention includes the possibility to tailor treatment of humans further by selecting antibody-based ligands with variable domains and/or constant domains based on gene segments found in many humans of the ethnic populations where the variant TOI forms are found to meet the selection criteria of the invention. This also applies mutatis mutandis where the TOI is human Nav1.9, as in the present example. Thus, all disclosure herein relating to tailoring variable and/or constant domains apply to the present example, relating to Nav1.9 and is combinable for use in one or more claims herein. All disclosure relating to variable and constant regions and polymorphism under the subtitle "Tailoring Antibodies to Rarer Nav1.7 Variant Profile" in the Nav1.7 Example is also incorporated into the present Nav1.9 Example for use mutatis mutandis with the present Nav1.9 invention and for possible inclusion in Nav1.9-limited claims herein.

Determination of Specific Binding of Ligands of the Invention to NAV1.9 Variants The specific binding of ligands of the invention to Nav1.9 variants can be performed using the SPR method described in Example 1.

Embodiments are provided as follows:—

Methods with VH Tailoring

1. A method of treating or reducing the risk of a Nav1.9-mediated disease or condition in a human in need thereof, the method comprising administering to said human a ligand (eg, an antibody or antibody fragment) that specifically binds a human Nav1.9 protein that comprises an amino acid selected from the group consisting of I381T, K419N, A582T, A681D, A842P, L1158P, F1689L, L811P, R225C, A808G, V909I, R86G, T1609I and G481E;
   wherein (i) the ligand comprises a VH domain derived from the recombination of a human VH segment, a human D gene segment and a human JH segment, the human VH segment encoding the framework 1 of SEQ ID NO: 40 and wherein said human comprises a VH gene segment encoding the framework 1 of SEQ ID NO: 40, or the human expresses VH domains that comprise the framework 1 of SEQ ID NO: 40; and
   wherein (ii) said human comprises a nucleotide sequence encoding said Nav1.9 protein comprising said amino acid selected from the group consisting of I381T, K419N, A582T, A681D, A842P, L1158P, F1689L, L811P, R225C, A808G, V909I, R86G, T1609I and G481E.

In an alternative, clause 1 provides:—

A method of targeting Nav1.9 in a human, the method comprising administering to said human a ligand (eg, an antibody or antibody fragment) that specifically binds a human Nav1.9 protein that comprises an amino acid selected from the group consisting of I381T, K419N, A582T, A681D, A842P, L1158P, F1689L, L811P, R225C, A808G, V909I, R86G, T1609I and G481E;
   wherein (i) the ligand comprises a VH domain derived from the recombination of a human VH segment, a human D gene segment and a human JH segment, the human VH segment encoding the framework 1 of SEQ ID NO: 40 and wherein said human comprises a VH gene segment encoding the framework 1 of SEQ ID NO: 40, or the human expresses VH domains that comprise the framework 1 of SEQ ID NO: 40; and
   wherein (ii) said human comprises a nucleotide sequence encoding said Nav1.9 protein comprising said amino acid selected from the group consisting of I381T, K419N, A582T, A681D, A842P, L1158P, F1689L, L811P, R225C, A808G, V909I, R86G, T1609I and G481E.

In an example, the human is suffering from or at risk of a Nav1.9-mediated disease or condition.

In an example, the method treats or reduces the risk of a Nav1.9-mediated disease or condition in the human.

2. The method of clause 1, wherein said amino acid is selected from the group consisting of I381T, K419N, A582T, A681D, A842P, L1158P and F1689L.
3. The method of clause 2, wherein the condition is small fibre neuropathy, numbness, tingling, cramps, joint pain, decreased vibration sensitivity or abnormal warmth or cold sensation.
4. The method of clause 1, wherein said amino acid is A808G or R225C.
5. The method of any preceding clause, wherein the VH gene segment comprised by said human is a germline VH gene segment.

6. The method of any preceding clause comprising, before said administering, selecting a human comprising said nucleotide sequence of (ii), wherein the human is the human of clause 1.
7. The method of any preceding clause, wherein the human has been determined to comprise the nucleotide sequence that encodes a Nav1.9 protein comprising said selected amino acid and/or a Nav1.9 protein comprising said selected amino acid.
8. The method of any preceding clause, comprising the step of determining that the human comprises (a) the nucleotide sequence that encodes a Nav1.9 protein comprising said selected amino acid and/or (b) a Nav1.9 protein comprising said selected amino acid, optionally, wherein the determining step is performed before administration of the antibody to the human.
9. The method of clause 8, wherein the step of determining comprises assaying a biological sample from the human for a nucleotide sequence encoding a Nav1.9 protein comprising said selected amino acid.
10. The method of clause 9, wherein the assaying comprises contacting the biological sample with at least one oligonucleotide probe comprising a sequence of at least 10 contiguous nucleotides of a nucleotide sequence encoding a Nav1.9 protein comprising said selected amino acid or comprising an antisense sequence of said contiguous nucleotides, wherein said sequence of contiguous nucleotides comprises a nucleotide sequence encoding said selected amino acid, thereby forming a complex when at least one nucleotide sequence encoding the Nav1.9 protein comprising said selected amino acid is present; and
detecting the presence or absence of the complex, wherein detecting the presence of the complex determines that the human comprises the Nav1.9 protein comprising said selected amino acid.
11. The method of clause 9, wherein the assaying comprises nucleic acid amplification and optionally one or more methods selected from sequencing, next generation sequencing, nucleic acid hybridization, and allele-specific amplification and/or wherein the assaying is performed in a multiplex format.
12. The method of clause 9 or 11, wherein said biological sample comprises serum, blood, feces, tissue, a cell, urine and/or saliva of said human.
13. The method of any preceding clause, wherein said human is indicated as heterozygous for a nucleotide sequence encoding the Nav1.9 protein comprising said selected amino acid, optionally, wherein said human is further indicated as comprising the nucleotide sequence of SEQ ID NO: 138 or said human is indicated as homozygous for a nucleotide sequence encoding the Nav1.9 protein comprising said selected amino acid.
14. The method of any preceding clause, wherein said human is or has been further determined to be substantially resistant to a pain or itching treatment.
15. The method of any preceding clause, wherein said human is receiving or has received a pain or itching treatment or has reduced responsiveness to a pain or itching treatment.
16. The method of any preceding clause, wherein said disease or condition is a pain or itching disease or condition.
17. The method of any preceding clause, wherein said disease or condition is neuropathic pain.
18. The method of any preceding clause, wherein said human has been diagnosed with at least one condition recited in clause 16 or 17.
19. The method of any preceding clause, wherein said antibody or antibody fragment treats or reduces the risk in said human of a condition recited in clause 16 or 17.
20. The method of any preceding clause, wherein the nucleotide sequence comprises one or more SNPs selected from the group consisting of rs33985936, rs78812474, rs72869687 and rs13059805.
21. The method of any preceding clause, wherein said ligand (eg, antibody or antibody fragment) is administered by inhaled, intravenous or subcutaneous administration and/or is comprised in an inhalable or injectable preparation.

Ligands with VH Tailoring

1. A ligand (eg, an antibody or antibody fragment) for use in a method of treating or reducing the risk of a Nav1.9-mediated disease or condition (eg, asthma) in a human in need thereof, wherein the ligand specifically binds a human Nav1.9 protein that comprises an amino acid selected from the group consisting of I381T, K419N, A582T, A681D, A842P, L1158P, F1689L, L811P, R225C, A808G, V909I, R86G, T1609I and G481E;
   wherein (i) the ligand comprises a VH domain derived from the recombination of a human VH segment, a human D gene segment and a human JH segment, the human VH segment encoding the framework 1 of SEQ ID NO: 40 and wherein said human comprises a VH gene segment encoding the framework 1 of SEQ ID NO: 40, or the human expresses VH domains that comprise the framework 1 of SEQ ID NO: 40; and
   wherein (ii) said human comprises a nucleotide sequence encoding said Nav1.9 protein comprising said amino acid selected from the group consisting of I381T, K419N, A582T, A681D, A842P, L1158P, F1689L, L811P, R225C, A808G, V909I, R86G, T1609I and G481E.

In an alternative, paragraph 1 provides:—

A ligand (eg, an antibody or antibody fragment) for use in a method of targeting Nav1.9 in a human, wherein the ligand specifically binds a human Nav1.9 protein that comprises an amino acid selected from the group consisting of I381T, K419N, A582T, A681D, A842P, L1158P, F1689L, L811P, R225C, A808G, V909I, R86G, T1609I and G481E;
wherein (i) the ligand comprises a VH domain derived from the recombination of a human VH segment, a human D gene segment and a human JH segment, the human VH segment encoding the framework 1 of SEQ ID NO: 40 and wherein said human comprises a VH gene segment encoding the framework 1 of SEQ ID NO: 40, or the human expresses VH domains that comprise the framework 1 of SEQ ID NO: 40; and
wherein (ii) said human comprises a nucleotide sequence encoding said Nav1.9 protein comprising said amino acid selected from the group consisting of I381T, K419N, A582T, A681D, A842P, L1158P, F1689L, L811P, R225C, A808G, V909I, R86G, T1609I and G481E.

In an example, the human is suffering from or at risk of a Nav1.9-mediated disease or condition.

In an example, the method treats or reduces the risk of a Nav1.9-mediated disease or condition in the human.

2. The ligand of clause 1, wherein said amino acid is selected from the group consisting of I381T, K419N, A582T, A681D, A842P, L1158P and F1689L.
3. The ligand of clause 2, wherein the condition is small fibre neuropathy, numbness, tingling, cramps, joint pain, decreased vibration sensitivity or abnormal warmth or cold sensation.
4. The ligand of clause 1, wherein said amino acid is A808G or R225C.

5. The ligand of any preceding clause, wherein the VH gene segment comprised by said human is a germline VH gene segment.
6. The ligand of any preceding clause said method comprising, before said administering, selecting a human comprising said nucleotide sequence of (ii), wherein the human is the human of clause 1.
7. The ligand of any preceding clause, wherein the human has been determined to comprise the nucleotide sequence that encodes a Nav1.9 protein comprising said selected amino acid selected and/or a Nav1.9 protein comprising said selected amino acid.
8. The ligand of any preceding clause, said method comprising the step of determining that the human comprises (a) the nucleotide sequence that encodes a Nav1.9 protein comprising said selected amino acid and/or (b) a Nav1.9 protein comprising said selected amino acid, optionally, wherein the determining step is performed before administration of the antibody to the human.
9. The ligand of clause 8, wherein the step of determining comprises assaying a biological sample from the human for a nucleotide sequence encoding a Nav1.9 protein comprising said selected amino acid.
10. The ligand of clause 9, wherein the assaying comprises contacting the biological sample with at least one oligonucleotide probe comprising a sequence of at least 10 contiguous nucleotides of a nucleotide sequence encoding a Nav1.9 protein comprising said selected amino acid or comprising an antisense sequence of said contiguous nucleotides, wherein said sequence of contiguous nucleotides comprises a nucleotide sequence encoding said selected amino acid, thereby forming a complex when at least one nucleotide sequence encoding the Nav1.9 protein comprising said selected amino acid is present; and
detecting the presence or absence of the complex, wherein detecting the presence of the complex determines that the human comprises the Nav1.9 protein comprising said selected amino acid.
11. The ligand of clause 9, wherein the assaying comprises nucleic acid amplification and optionally one or more methods selected from sequencing, next generation sequencing, nucleic acid hybridization, and allele-specific amplification and/or wherein the assaying is performed in a multiplex format.
12. The ligand of clause 9 or 11, wherein said biological sample comprises serum, blood, feces, tissue, a cell, urine and/or saliva of said human.
13. The ligand of any preceding clause, wherein said human is indicated as heterozygous for a nucleotide sequence encoding the Nav1.9 protein comprising said selected amino acid, optionally, wherein said human is further indicated as comprising the nucleotide sequence of SEQ ID NO: 138, or said human is indicated as homozygous for a nucleotide sequence encoding the Nav1.9 protein comprising said selected amino acid.
14. The ligand of any preceding clause, wherein said human is or has been further determined to be substantially resistant to a pain or itching treatment.
15. The ligand of any preceding clause, wherein said human is receiving or has received a pain or itching treatment or has reduced responsiveness to a pain or itching treatment.
16. The ligand of any preceding clause, wherein said disease or condition is a pain or itching disease or condition.
17. The ligand of any preceding clause, wherein said disease or condition is neuropathic pain.
18. The ligand of any preceding clause, wherein said human has been diagnosed with at least one condition recited in clause 16 or 17.
19. The ligand of any preceding clause, wherein said antibody or antibody fragment treats or reduces the risk in said human of a condition recited in clause 16 or 17.
20. The ligand of any preceding clause, wherein the nucleotide sequence comprises one or more SNPs selected from the group consisting of rs33985936, rs78812474, rs72869687 and rs13059805.
21. The ligand of any preceding clause, wherein said ligand (eg, antibody or antibody fragment) is for inhaled, intravenous or subcutaneous administration and/or is comprised in an inhalable or injectable preparation.

Methods with Gamma-4 Constant Region Tailoring

1. A method of treating or reducing the risk of a Nav1.9-mediated disease or condition in a human in need thereof, the method comprising administering to said human a ligand (eg, an antibody or antibody fragment) that specifically binds a human Nav1.9 protein that comprises an amino acid selected from the group consisting of I381T, K419N, A582T, A681D, A842P, L1158P, F1689L, L811P, R225C, A808G, V909I, R86G, T1609I and G481E;
wherein (i) the ligand comprises a human gamma-4 heavy chain constant region that comprises a Leu at position 189 shown in SEQ ID NO: 73 or an Arg at position 289 shown in SEQ ID NO: 73 and wherein said human comprises (i) an IGHG4*01 human heavy chain constant region gene segment, or the human expresses antibodies comprising human gamma-4 heavy chain constant regions comprising a Leu at position 189 shown in SEQ ID NO: 73 or an Arg at position 289 shown in SEQ ID NO: 73; and
wherein (ii) said human comprises a nucleotide sequence encoding said Nav1.9 protein comprising said amino acid selected from the group consisting of I381T, K419N, A582T, A681D, A842P, L1158P, F1689L, L811P, R225C, A808G, V909I, R86G, T1609I and G481E.

In an alternative, clause 1 provides:—

A method of targeting Nav1.9 in a human, the method comprising administering to said human a ligand (eg, an antibody or antibody fragment) that specifically binds a human Nav1.9 protein that comprises an amino acid selected from the group consisting of I381T, K419N, A582T, A681D, A842P, L1158P, F1689L, L811P, R225C, A808G, V909I, R86G, T1609I and G481E;
wherein (i) the ligand comprises a human gamma-4 heavy chain constant region that comprises a Leu at position 189 shown in SEQ ID NO: 73 or an Arg at position 289 shown in SEQ ID NO: 73 and wherein said human comprises (i) an IGHG4*01 human heavy chain constant region gene segment, or the human expresses antibodies comprising human gamma-4 heavy chain constant regions comprising a Leu at position 189 shown in SEQ ID NO: 73 or an Arg at position 289 shown in SEQ ID NO: 73; and
wherein (ii) said human comprises a nucleotide sequence encoding said Nav1.9 protein comprising said amino acid selected from the group consisting of I381T, K419N, A582T, A681D, A842P, L1158P, F1689L, L811P, R225C, A808G, V909I, R86G, T1609I and G481E.

In an example, the human is suffering from or at risk of a Nav1.9-mediated disease or condition.

In an example, the method treats or reduces the risk of a Nav1.9-mediated disease or condition in the human.

2. The method of clause 1, wherein said amino acid is selected from the group consisting of I381T, K419N, A582T, A681D, A842P, L1158P and F1689L.
3. The method of clause 2, wherein the condition is small fibre neuropathy, numbness, tingling, cramps, joint pain, decreased vibration sensitivity or abnormal warmth or cold sensation.
4. The method of clause 1, wherein said amino acid is A808G or R225C.
5. The method of any preceding clause, wherein the constant region gene segment comprised by said human is a germline gene segment.
6. The method of any preceding clause comprising, before said administering, selecting a human comprising said nucleotide sequence of (ii), wherein the human is the human of clause 1.
7. The method of any preceding clause, wherein the human has been determined to comprise the nucleotide sequence that encodes a Nav1.9 protein comprising said selected amino acid and/or a Nav1.9 protein comprising said selected amino acid.
8. The method of any preceding clause, comprising the step of determining that the human comprises (a) the nucleotide sequence that encodes a Nav1.9 protein comprising said selected amino acid and/or (b) a Nav1.9 protein comprising said selected amino acid, optionally, wherein the determining step is performed before administration of the antibody to the human.
9. The method of clause 8, wherein the step of determining comprises assaying a biological sample from the human for a nucleotide sequence encoding a Nav1.9 protein comprising said selected amino acid.
10. The method of clause 9, wherein the assaying comprises
    contacting the biological sample with at least one oligonucleotide probe comprising a sequence of at least 10 contiguous nucleotides of a nucleotide sequence encoding a Nav1.9 protein comprising said selected amino acid or comprising an antisense sequence of said contiguous nucleotides, wherein said sequence of contiguous nucleotides comprises a nucleotide sequence encoding said selected amino acid, thereby forming a complex when at least one nucleotide sequence encoding the Nav1.9 protein comprising said selected amino acid is present; and
    detecting the presence or absence of the complex, wherein detecting the presence of the complex determines that the human comprises the Nav1.9 protein comprising said selected amino acid.
11. The method of clause 9, wherein the assaying comprises nucleic acid amplification and optionally one or more methods selected from sequencing, next generation sequencing, nucleic acid hybridization, and allele-specific amplification and/or wherein the assaying is performed in a multiplex format.
12. The method of clause 9 or 11, wherein said biological sample comprises serum, blood, feces, tissue, a cell, urine and/or saliva of said human.
13. The method of any preceding clause, wherein said human is indicated as heterozygous for a nucleotide sequence encoding the Nav1.9 protein comprising said selected amino acid, optionally, wherein said human is further indicated as comprising the nucleotide sequence of SEQ ID NO: 138 or said human is indicated as homozygous for a nucleotide sequence encoding the Nav1.9 protein comprising said selected amino acid.
14. The method of any preceding clause, wherein said human is or has been further determined to be substantially resistant to a pain or itching treatment.
15. The method of any preceding clause, wherein said human is receiving or has received a pain or itching treatment or has reduced responsiveness to a pain or itching treatment.
16. The method of any preceding clause, wherein said disease or condition is a pain or itching disease or condition.
17. The method of any preceding clause, wherein said disease or condition is neuropathic pain.
18. The method of any preceding clause, wherein said human has been diagnosed with at least one condition recited in clause 16 or 17.
19. The method of any preceding clause, wherein said antibody or antibody fragment treats or reduces the risk in said human of a condition recited in clause 16 or 17.
20. The method of any preceding clause, wherein the nucleotide sequence comprises one or more SNPs selected from the group consisting of rs33985936, rs78812474, rs72869687 and rs13059805.
21. The method of any preceding clause, wherein said ligand (eg, antibody or antibody fragment) is administered by inhaled, intravenous or subcutaneous administration and/or is comprised in an inhalable or injectable preparation.
22. The method of any preceding clause, wherein the human gamma-4 heavy chain constant region of the ligand comprises the amino acid sequence of SEQ ID NO: 73 or an ADCC inactivated version thereof.
23. The method of any preceding clause, wherein the human gamma-4 heavy chain constant region comprises 228P and 235E.

Ligands with Gamma-4 Constant Region Tailoring

1. A ligand (eg, an antibody or antibody fragment) for use in a method of treating or reducing the risk of a Nav1.9-mediated disease or condition (eg, pain) in a human in need thereof, wherein the ligand specifically binds a human Nav1.9 protein that comprises an amino acid selected from the group consisting of I381T, K419N, A582T, A681D, A842P, L1158P, F1689L, L811P, R225C, A808G, V909I, R86G, T1609I and G481E;
    wherein (i) the ligand comprises a human gamma-4 heavy chain constant region that comprises a Leu at position 189 shown in SEQ ID NO: 73 or an Arg at position 289 shown in SEQ ID NO: 73 and wherein said human comprises (i) an IGHG4*01 human heavy chain constant region gene segment, or the human expresses antibodies comprising human gamma-4 heavy chain constant regions comprising a Leu at position 189 shown in SEQ ID NO: 73 or an Arg at position 289 shown in SEQ ID NO: 73; and
    wherein (ii) said human comprises a nucleotide sequence encoding said Nav1.9 protein comprising said amino acid selected from the group consisting of I381T, K419N, A582T, A681D, A842P, L1158P, F1689L, L811P, R225C, A808G, V909I, R86G, T1609I and G481E.

In an alternative, paragraph 1 provides:—
    A ligand (eg, an antibody or antibody fragment) for use in a method of targeting Nav1.9 in a human, wherein the ligand specifically binds a human Nav1.9 protein that comprises an amino acid selected from the group consisting of I381T, K419N, A582T, A681D, A842P, L1158P, F1689L, L811P, R225C, A808G, V909I, R86G, T1609I and G481E;
    wherein (i) the ligand comprises a human gamma-4 heavy chain constant region that comprises a Leu at position 189 shown in SEQ ID NO: 73 or an Arg at position 289 shown in SEQ ID NO: 73 and wherein said human comprises (i) an IGHG4*01 human heavy chain constant region gene segment, or the human expresses antibodies comprising human gamma-4 heavy chain constant regions comprising a Leu at position 189 shown in SEQ ID NO: 73 or an Arg at position 289 shown in SEQ ID NO: 73; and wherein (ii) said human comprises a nucleotide sequence encoding said Nav1.9 protein comprising said amino acid selected from the group consisting of I381T, K419N, A582T, A681D, A842P, L1158P, F1689L, L811P, R225C, A808G, V909I, R86G, T1609I and G481E.

In an example, the human is suffering from or at risk of a Nav1.9-mediated disease or condition.

In an example, the method treats or reduces the risk of a Nav1.9-mediated disease or condition in the human.

2. The ligand of clause 1, wherein said amino acid is selected from the group consisting of I381T, K419N, A582T, A681D, A842P, L1158P and F1689L.

3. The ligand of clause 2, wherein the condition is small fibre neuropathy, numbness, tingling, cramps, joint pain, decreased vibration sensitivity or abnormal warmth or cold sensation.

4. The ligand of clause 1, wherein said amino acid is A808G or R225C.

5. The ligand of any preceding clause, wherein the constant region gene segment comprised by said human is a germline gene segment.

6. The ligand of any preceding clause said method comprising, before said administering, selecting a human comprising said nucleotide sequence of (ii), wherein the human is the human of clause 1.

7. The ligand of any preceding clause, wherein the human has been determined to comprise the nucleotide sequence that encodes a Nav1.9 protein comprising said selected amino acid selected and/or a Nav1.9 protein comprising said selected amino acid.

8. The ligand of any preceding clause, said method comprising the step of determining that the human comprises (a) the nucleotide sequence that encodes a Nav1.9 protein comprising said selected amino acid and/or (b) a Nav1.9 protein comprising said selected amino acid, optionally, wherein the determining step is performed before administration of the antibody to the human.

9. The ligand of clause 8, wherein the step of determining comprises assaying a biological sample from the human for a nucleotide sequence encoding a Nav1.9 protein comprising said selected amino acid.

10. The ligand of clause 9, wherein the assaying comprises contacting the biological sample with at least one oligonucleotide probe comprising a sequence of at least 10 contiguous nucleotides of a nucleotide sequence encoding a Nav1.9 protein comprising said selected amino acid or comprising an antisense sequence of said contiguous nucleotides, wherein said sequence of contiguous nucleotides comprises a nucleotide sequence encoding said selected amino acid, thereby forming a complex when at least one nucleotide sequence encoding the Nav1.9 protein comprising said selected amino acid is present; and detecting the presence or absence of the complex, wherein detecting the presence of the complex determines that the human comprises the Nav1.9 protein comprising said selected amino acid.

11. The ligand of clause 9, wherein the assaying comprises nucleic acid amplification and optionally one or more methods selected from sequencing, next generation sequencing, nucleic acid hybridization, and allele-specific amplification and/or wherein the assaying is performed in a multiplex format.

12. The ligand of clause 9 or 11, wherein said biological sample comprises serum, blood, feces, tissue, a cell, urine and/or saliva of said human.

13. The ligand of any preceding clause, wherein said human is indicated as heterozygous for a nucleotide sequence encoding the Nav1.9 protein comprising said selected amino acid, optionally, wherein said human is further indicated as comprising the nucleotide sequence of SEQ ID NO: 138, or said human is indicated as homozygous for a nucleotide sequence encoding the Nav1.9 protein comprising said selected amino acid.

14. The ligand of any preceding clause, wherein said human is or has been further determined to be substantially resistant to a pain or itching treatment.

15. The ligand of any preceding clause, wherein said human is receiving or has received a pain or itching treatment or has reduced responsiveness to a pain or itching treatment.

16. The ligand of any preceding clause, wherein said disease or condition is a pain or itching disease or condition.

17. The ligand of any preceding clause, wherein said disease or condition is neuropathic pain.

18. The ligand of any preceding clause, wherein said human has been diagnosed with at least one condition recited in clause 16 or 17.

19. The ligand of any preceding clause, wherein said antibody or antibody fragment treats or reduces the risk in said human of a condition recited in clause 16 or 17.

20. The ligand of any preceding clause, wherein the nucleotide sequence comprises one or more SNPs selected from the group consisting of rs33985936, rs78812474, rs72869687 and rs13059805.

21. The ligand of any preceding clause, wherein said ligand (eg, antibody or antibody fragment) is for inhaled, intravenous or subcutaneous administration and/or is comprised in an inhalable or injectable preparation.

22. The ligand of any preceding clause, wherein the human gamma-4 heavy chain constant region of the ligand comprises the amino acid sequence of SEQ ID NO: 73 or an ADCC inactivated version thereof.

23. The ligand of any preceding clause, wherein the human gamma-4 heavy chain constant region comprises 228P and 235E.

Methods with Gamma-2 Constant Region Tailoring

1. A method of treating or reducing the risk of a Nav1.9-mediated disease or condition in a human in need thereof, the method comprising administering to said human a ligand (eg, an antibody or antibody fragment) that specifically binds a human Nav1.9 protein that comprises an amino acid selected from the group consisting of I381T, K419N, A582T, A681D, A842P, L1158P, F1689L, L811P, R225C, A808G, V909I, R86G, T1609I and G481E;

wherein (i) the ligand comprises a human gamma-2 heavy chain constant region that comprises an amino acid selected from the group consisting of a Pro at position 72 shown in SEQ ID NO: 6, an Asn at position 75 shown in SEQ ID NO: 6, a Phe at position 76 shown in SEQ ID NO: 6, a Val at position 161 shown in SEQ ID NO: 6 and an Ala at position 257 shown in SEQ ID NO: 6 and wherein said human comprises (i) an IGHG2*01 human heavy chain constant region gene segment, or the human expresses antibodies comprising human gamma-2 heavy chain constant regions comprising said selected Pro at position 72 shown in SEQ ID NO: 6, Asn at position 75 shown in SEQ ID NO: 6, Phe at position 76 shown in SEQ ID NO: 6, Val at position 161 shown in SEQ ID NO: 6 or Ala at position 257 shown in SEQ ID NO: 6; and wherein (ii) said human comprises a nucleotide sequence encoding said Nav1.9 protein comprising said amino acid selected from the group consisting of I381T, K419N, A582T, A681D, A842P, L1158P, F1689L, L811P, R225C, A808G, V909I, R86G, T1609I and G481E.

In an alternative, clause 1 provides:—

A method of targeting Nav1.9 in a human, the method comprising administering to said human a ligand (eg, an antibody or antibody fragment) that specifically binds a human Nav1.9 protein that comprises an amino acid selected from the group consisting of I381T, K419N, A582T, A681D, A842P, L1158P, F1689L, L811P, R225C, A808G, V909I, R86G, T1609I and G481E;

wherein (i) the ligand comprises a human gamma-2 heavy chain constant region that comprises an amino acid selected from the group consisting of a Pro at position 72 shown in SEQ ID NO: 6, an Asn at position 75 shown in SEQ ID NO: 6, a Phe at position 76 shown in SEQ ID NO: 6, a Val at position 161 shown in SEQ ID NO: 6 and an Ala at position 257 shown in SEQ ID NO: 6 and wherein said human comprises (i) an IGHG2*01 human heavy chain constant region gene segment, or the human expresses antibodies comprising human gamma-2 heavy chain constant regions comprising said selected Pro at position 72 shown in SEQ ID NO: 6, Asn at position 75 shown in SEQ ID NO: 6, Phe at position 76 shown in SEQ ID NO: 6, Val at position 161 shown in SEQ ID NO: 6 or Ala at position 257 shown in SEQ ID NO: 6; and wherein (ii) said human comprises a nucleotide sequence encoding said Nav1.9 protein comprising said amino acid selected from the group consisting of I381T, K419N, A582T, A681D, A842P, L1158P, F1689L, L811P, R225C, A808G, V909I, R86G, T1609I and G481E.

In an example, the human is suffering from or at risk of a Nav1.9-mediated disease or condition. In an example, the method treats or reduces the risk of a Nav1.9-mediated disease or condition in the human.

2. The method of clause 1, wherein said amino acid is selected from the group consisting of I381T, K419N, A582T, A681D, A842P, L1158P and F1689L.

3. The method of clause 2, wherein the condition is small fibre neuropathy, numbness, tingling, cramps, joint pain, decreased vibration sensitivity or abnormal warmth or cold sensation.

4. The method of clause 1, wherein said amino acid is A808G or R225C.

5. The method of any preceding clause, wherein the constant region gene segment comprised by said human is a germline gene segment.

6. The method of any preceding clause comprising, before said administering, selecting a human comprising said nucleotide sequence of (ii), wherein the human is the human of clause 1.

7. The method of any preceding clause, wherein the human has been determined to comprise the nucleotide sequence that encodes a Nav1.9 protein comprising said selected amino acid and/or a Nav1.9 protein comprising said selected amino acid.

8. The method of any preceding clause, comprising the step of determining that the human comprises (a) the nucleotide sequence that encodes a Nav1.9 protein comprising said selected amino acid and/or (b) a Nav1.9 protein comprising said selected amino acid, optionally, wherein the determining step is performed before administration of the antibody to the human.

9. The method of clause 8, wherein the step of determining comprises assaying a biological sample from the human for a nucleotide sequence encoding a Nav1.9 protein comprising said selected amino acid.

10. The method of clause 9, wherein the assaying comprises contacting the biological sample with at least one oligonucleotide probe comprising a sequence of at least 10 contiguous nucleotides of a nucleotide sequence encoding a Nav1.9 protein comprising said selected amino acid or comprising an antisense sequence of said contiguous nucleotides, wherein said sequence of contiguous nucleotides comprises a nucleotide sequence encoding said selected amino acid, thereby forming a complex when at least one nucleotide sequence encoding the Nav1.9 protein comprising said selected amino acid is present; and detecting the presence or absence of the complex, wherein detecting the presence of the complex determines that the human comprises the Nav1.9 protein comprising said selected amino acid.

11. The method of clause 9, wherein the assaying comprises nucleic acid amplification and optionally one or more methods selected from sequencing, next generation sequencing, nucleic acid hybridization, and allele-specific amplification and/or wherein the assaying is performed in a multiplex format.

12. The method of clause 9 or 11, wherein said biological sample comprises serum, blood, feces, tissue, a cell, urine and/or saliva of said human.

13. The method of any preceding clause, wherein said human is indicated as heterozygous for a nucleotide sequence encoding the Nav1.9 protein comprising said selected amino acid, optionally, wherein said human is further indicated as comprising the nucleotide sequence of SEQ ID NO: 138 or said human is indicated as homozygous for a nucleotide sequence encoding the Nav1.9 protein comprising said selected amino acid.

14. The method of any preceding clause, wherein said human is or has been further determined to be substantially resistant to a pain or itching treatment.

15. The method of any preceding clause, wherein said human is receiving or has received a pain or itching treatment or has reduced responsiveness to a pain or itching treatment.

16. The method of any preceding clause, wherein said disease or condition is a pain or itching disease or condition.

17. The method of any preceding clause, wherein said disease or condition is neuropathic pain.

18. The method of any preceding clause, wherein said human has been diagnosed with at least one condition recited in clause 16 or 17.

19. The method of any preceding clause, wherein said antibody or antibody fragment treats or reduces the risk in said human of a condition recited in clause 16 or 17.

20. The method of any preceding clause, wherein the nucleotide sequence comprises one or more SNPs selected from the group consisting of rs33985936, rs78812474, rs72869687 and rs13059805.

21. The method of any preceding clause, wherein said ligand (eg, antibody or antibody fragment) is administered by inhaled, intravenous or subcutaneous administration and/or is comprised in an inhalable or injectable preparation.

22. The method of any preceding clause, wherein the human gamma-2 heavy chain constant region of the ligand comprises IGHG2*01 amino acid sequence or an ADCC inactivated version thereof.

Ligands with Gamma-2 Constant Region Tailoring

1. A ligand (eg, an antibody or antibody fragment) for use in a method of treating or reducing the risk of a Nav1.9-mediated disease or condition (eg, pain) in a human in need thereof, wherein the ligand specifically binds a human Nav1.9 protein that comprises an amino acid selected from the group consisting of I381T, K419N, A582T, A681D, A842P, L1158P, F1689L, L811P, R225C, A808G, V909I, R86G, T1609I and G481E;
  wherein (i) the ligand comprises a human gamma-2 heavy chain constant region that comprises an amino acid selected from the group consisting of a Pro at position 72 shown in SEQ ID NO: 6, an Asn at position 75 shown in SEQ ID NO: 6, a Phe at position 76 shown in SEQ ID NO: 6, a Val at position 161 shown in SEQ ID NO: 6 and an Ala at position 257 shown in SEQ ID NO: 6 and wherein said human comprises (i) an IGHG2*01 human heavy chain constant region gene segment, or the human expresses antibodies comprising human gamma-2 heavy chain constant regions comprising said selected Pro at position 72 shown in SEQ ID NO: 6, Asn at position 75 shown in SEQ ID NO: 6, Phe at position 76 shown in SEQ ID NO: 6, Val at position 161 shown in SEQ ID NO: 6 or Ala at position 257 shown in SEQ ID NO: 6; and
  wherein (ii) said human comprises a nucleotide sequence encoding said Nav1.9 protein comprising said amino acid selected from the group consisting of I381T, K419N, A582T, A681D, A842P, L1158P, F1689L, L811P, R225C, A808G, V909I, R86G, T1609I and G481E.

In an alternative, paragraph 1 provides:—

A ligand (eg, an antibody or antibody fragment) for use in a method of targeting Nav1.9 in a human, wherein the ligand specifically binds a human Nav1.9 protein that comprises an amino acid selected from the group consisting of I381T, K419N, A582T, A681D, A842P, L1158P, F1689L, L811P, R225C, A808G, V909I, R86G, T1609I and G481E;
  wherein (i) the ligand comprises a human gamma-2 heavy chain constant region that comprises an amino acid selected from the group consisting of a Pro at position 72 shown in SEQ ID NO: 6, an Asn at position 75 shown in SEQ ID NO: 6, a Phe at position 76 shown in SEQ ID NO: 6, a Val at position 161 shown in SEQ ID NO: 6 and an Ala at position 257 shown in SEQ ID NO: 6 and wherein said human comprises (i) an IGHG2*01 human heavy chain constant region gene segment, or the human expresses antibodies comprising human gamma-2 heavy chain constant regions comprising said selected Pro at position 72 shown in SEQ ID NO: 6, Asn at position 75 shown in SEQ ID NO: 6, Phe at position 76 shown in SEQ ID NO: 6, Val at position 161 shown in SEQ ID NO: 6 or Ala at position 257 shown in SEQ ID NO: 6; and
  wherein (ii) said human comprises a nucleotide sequence encoding said Nav1.9 protein comprising said amino acid selected from the group consisting of I381T, K419N, A582T, A681D, A842P, L1158P, F1689L, L811P, R225C, A808G, V909I, R86G, T1609I and G481E.

In an example, the human is suffering from or at risk of a Nav1.9-mediated disease or condition. In an example, the method treats or reduces the risk of a Nav1.9-mediated disease or condition in the human.

2. The ligand of clause 1, wherein said amino acid is selected from the group consisting of I381T, K419N, A582T, A681D, A842P, L1158P and F1689L.

3. The ligand of clause 2, wherein the condition is small fibre neuropathy, numbness, tingling, cramps, joint pain, decreased vibration sensitivity or abnormal warmth or cold sensation.

4. The ligand of clause 1, wherein said amino acid is A808G or R225C.

5. The ligand of any preceding clause, wherein the constant region gene segment comprised by said human is a germline gene segment.

6. The ligand of any preceding clause said method comprising, before said administering, selecting a human comprising said nucleotide sequence of (ii), wherein the human is the human of clause 1.

7. The ligand of any preceding clause, wherein the human has been determined to comprise the nucleotide sequence that encodes a Nav1.9 protein comprising said selected amino acid selected and/or a Nav1.9 protein comprising said selected amino acid.

8. The ligand of any preceding clause, said method comprising the step of determining that the human comprises (a) the nucleotide sequence that encodes a Nav1.9 protein comprising said selected amino acid and/or (b) a Nav1.9 protein comprising said selected amino acid, optionally, wherein the determining step is performed before administration of the antibody to the human.

9. The ligand of clause 8, wherein the step of determining comprises assaying a biological sample from the human for a nucleotide sequence encoding a Nav1.9 protein comprising said selected amino acid.

10. The ligand of clause 9, wherein the assaying comprises contacting the biological sample with at least one oligonucleotide probe comprising a sequence of at least 10 contiguous nucleotides of a nucleotide sequence encoding a Nav1.9 protein comprising said selected amino acid or comprising an antisense sequence of said contiguous nucleotides, wherein said sequence of contiguous nucleotides comprises a nucleotide sequence encoding said selected amino acid, thereby forming a complex when at least one nucleotide sequence encoding the Nav1.9 protein comprising said selected amino acid is present; and
  detecting the presence or absence of the complex, wherein detecting the presence of the complex determines that the human comprises the Nav1.9 protein comprising said selected amino acid.

11. The ligand of clause 9, wherein the assaying comprises nucleic acid amplification and optionally one or more methods selected from sequencing, next generation sequencing, nucleic acid hybridization, and allele-specific amplification and/or wherein the assaying is performed in a multiplex format.

12. The ligand of clause 9 or 11, wherein said biological sample comprises serum, blood, feces, tissue, a cell, urine and/or saliva of said human.

13. The ligand of any preceding clause, wherein said human is indicated as heterozygous for a nucleotide sequence encoding the Nav1.9 protein comprising said selected amino acid, optionally, wherein said human is further indicated as comprising the nucleotide sequence of SEQ ID NO: 138, or said human is indicated as homozygous for a nucleotide sequence encoding the Nav1.9 protein comprising said selected amino acid.

14. The ligand of any preceding clause, wherein said human is or has been further determined to be substantially resistant to a pain or itching treatment.
15. The ligand of any preceding clause, wherein said human is receiving or has received a pain or itching treatment or has reduced responsiveness to a pain or itching treatment.
16. The ligand of any preceding clause, wherein said disease or condition is a pain or itching disease or condition.
17. The ligand of any preceding clause, wherein said disease or condition is neuropathic pain.
18. The ligand of any preceding clause, wherein said human has been diagnosed with at least one condition recited in clause 16 or 17.
19. The ligand of any preceding clause, wherein said antibody or antibody fragment treats or reduces the risk in said human of a condition recited in clause 16 or 17.
20. The ligand of any preceding clause, wherein the nucleotide sequence comprises one or more SNPs selected from the group consisting of rs33985936, rs78812474, rs72869687 and rs13059805.
21. The ligand of any preceding clause, wherein said ligand (eg, antibody or antibody fragment) is for inhaled, intravenous or subcutaneous administration and/or is comprised in an inhalable or injectable preparation.
22. The ligand of any preceding clause, wherein the human gamma-2 heavy chain constant region of the ligand comprises IGHG2*01 amino acid sequence or an ADCC inactivated version thereof.

In any embodiment or example of the Nav1.9-focused invention, the method optionally reduces a symptom of neuropathic pain or inflammatory pain; or optionally the ligand is for reducing a symptom of neuropathic pain or inflammatory pain.

In any embodiment or example of the Nav1.9-focused invention said selected amino acid may be regarded as a mutation in SEQ ID NO: 137.

In an example, the human is suffering from or at risk of a Nav1.9-mediated disease or condition. In an example, the method treats or reduces the risk of a Nav1.9-mediated disease or condition in the human.

SEQUENCE LISTING (138 sequences)

SEQ ID NO: 1 - protein, 692 aa, Homo sapiens
MGTVSSRRSWWPLPLLLLLLLLLGPAGARAQEDEDGDYEELVLALRSEEDGLAEAPEHGTTATFHRCAKDPWRLPGTYVVVLKEETHLSQSERTARRLQAQAARRGYLTKILHVFHGLLPGFLVKMSGDLLELALKLPHVDYIEEDSSVFAQSIPWNLERITPPRYRADEYQPPDGGSLVEVYLLDTSIQSDHREIEGRVMVTDFENVPEEDGTRFHRQASKCDSHGTHLAGVVSGRDAGVAKGASMRSLRVLNCQGKGTVSGTLIGLEFIRKSQLVQPVGPLVVLLPLAGGYSRVLNAACQRLARAGVVLVTAAGNFRDDACLYSPASAPEVITVGATNAQDQPVTLGTLGTNFGRCVDLFAPGEDIIGASSDCSTCFVSQSGTSQAAAHVAGIAAMMLSAEPELTLAELRQRLIHFSAKDVINEAWFPEDQRVLTPNLVAALPPSTHGAGWQLFCRTVWSAHSGPTRMATAIARCAPDEELLSCSSFSRSGKRRGERMEAQGGKLVCRAHNAFGGEGVYAIARCCLLPQANCSVHTAPPAEASMGTRVHCHQQGHVLTGCSSHWEVEDLGTHKPPVLRPRGQPNQCVGHREASIHASCCHAPGLECKVKEHGIPAPQEQVTVACEEGWTLTGCSALPGTSHVLGAYAVDNTCVVRSRDVSTTGSTSEEAVTAVAICCRSRHLAQASQELQ

SEQ ID NO: 2 - protein, 662 aa, Homo sapiens
QEDEDGDYEELVLALRSEEDGLAEAPEHGTTATFHRCAKDPWRLPGTYVVVLKEETHLSQSERTARRLQAQAARRGYLTKILHVFHGLLPGFLVKMSGDLLELALKLPHVDYIEEDSSVFAQSIPWNLERITPPRYRADEYQPPDGGSLVEVYLLDTSIQSDHREIEGRVMVTDFENVPEEDGTRFHRQASKCDSHGTHLAGVVSGRDAGVAKGASMRSLRVLNCQGKGTVSGTLIGLEFIRKSQLVQPVGPLVVLLPLAGGYSRVLNAACQRLARAGVVLVTAAGNFRDDACLYSPASAPEVITVGATNAQDQPVTLGTLGTNFGRCVDLFAPGEDIIGASSDCSTCFVSQSGTSQAAAHVAGIAAMMLSAEPELTLAELRQRLIHFSAKDVINEAWFPEDQRVLTPNLVAALPPSTHGAGWQLFCRTVWSAHSGPTRMATAIARCAPDEELLSCSSFSRSGKRRGERMEAQGGKLVCRAHNAFGGEGVYAIARCCLLPQANCSVHTAPPAEASMGTRVHCHQQGHVLTGCSSHWEVEDLGTHKPPVLRPRGQPNQCVGHREASIHASCCHAPGLECKVKEHGIPAPQEQVTVACEEGWTLTGCSALPGTSHVLGAYAVDNTCVVRSRDVSTTGSTSEEAVTAVAICCRSRHLAQASQELQ

SEQ ID NO: 3 - protein, 540 aa, Homo sapiens [sequence omitted]

SEQ ID NO: 4 - protein, 692 aa, Homo sapiens [sequence omitted]

SEQ ID NO: 5 - protein, 662 aa, Homo sapiens
QEDEDGDYEELVLALRSEEDGLAEAPEHGTTATFHRCAKDPWRLPGTYVVVLKEETHLSQSERTARRLQAQAARRGYLTKILHVFHGLLPGFLVKMSGDLLELALKLPHVDYIEEDSSVFAQSIPWNLERITPPRYRADEYQPPDGGSLVEVYLLDTSIQSDHREIEGRVMVTDFENVPEEDGTRFHRQASKCDSHGTHLAGVVSGRDAGVAKGASMRSLRVLNCQGKGTVSGTLIGLEFIRKSQLVQPVGPLVVLLPLAGGYSRVLNAACQRLARAGVVLVTAAGNFRDDACLYSPASAPEVITVGATNAQDQPVTLGTLGTNFGRCVDLFAPGEDIIGASSDCSTCFVSQSGTSQAAAHVAGIAAMMLSAEPELTLAELRQRLIHFSAKDVINEAWFPEDQRVLTPNLVAALPPSTHGAGWQLFCRTVWSAHSGPTRMATAVARCAPDEELLSCSSFSRSGKRRGERMEAQGGKLVCRAHNAFGGEGVYAIARCCLLPQANCSVHTAPPAEASMGTRVHCHQQGHVLTGCSSHWEVEDLGTHKPPVLRPRGQPNQCVGHREASIHASCCHAPGLECKVKEHGIPAPQEQVTVACEEGWTLTGCSALPGTSHVLGAYAVDNTCVVRSRDVSTTGSTSEEAVTAVAICCRSRHLAQASQELQ

SEQ ID NO: 6 - protein, 540 aa, Homo sapiens
SIPWNLERITPPRYRADEYQPPDGGSLVEVYLLDTSIQSDHREIEGRVMVTDFENVPEEDGTRFHRQASKCDSHGTHLAGVVSGRDAGVAKGASMRSLRVLNCQGKGTVSGTLIGLEFIRKSQLVQPVGPLVVLLPLAGGYSRVLNAACQRLARAGVVLVTAAGNFRDDACLYSPASAPEVITVGATNAQDQPVTLGTLGTNFGRCVDLFAPGEDIIGASSDCSTCFVSQSGTSQAAAHVAGIAAMMLSAEPELTLAELRQRLIHFSAKDVINEAWFPEDQRVLTPNLVAALPPSTHGAGWQLFCRTVWSAHSGPTRMATAVARCAPDEELLSCSSFSRSGKRRGERMEAQGGKLVCRAHNAFGGEGVYAIARCCLLPQANCSVHTAPPAEASMGTRVHCHQQGHVLTGCSSHWEVEDLGTHKPPVLRPRGQPNQCVGHREASIHASCCHAPGLECKVKEHGIPAPQEQVTVACEEGWTLTGCSALPGTSHVLGAYAVDNTCVVRSRDVSTTGSTSEEAVTAVAICCRSRHLAQASQELQ

SEQ ID NO: 7 - protein, 692 aa, Homo sapiens [sequence omitted]

SEQ ID NO: 8 - protein, 662 aa, Homo sapiens
QEDEDGDYEELVLALRSEEDGLAEAPEHGTTATFHRCAKDPWRLPGTYVVVLKEETHLSQSERTARRLQAQAARRGYLTKILHVFHGLLPGFLVKMSGDLLELALKLPHVDYIEEDSSVFAQSIPWNLERITPPRYRADEYQPPDGGSLVEVYLLDTSIQSDHREIEGRVMVTDFENVPEEDGTRFHRQASKCDSHGTHLAGVVSGRDAGVAKGASMRSLRVLNCQGKGTVSGTLIGLEFIRKSQLVQPVGPLVVLLPLAGGYSRVLNAACQRLARAGVVLVTAAGNFRDDACLYSPASAPEVITVGATNAQDQPVTLGTLGTNFGRCVDLFAPGEDIIGASSDCSTCFVSQSGTSQAAAHVAGIAAMMLSAEPELTLAELRQRLIHFSAKDVINEAWFPEDQRVLTPNLVAALPPSTHGAGWQLFCRTVWSAHSGPTRMATAIARCAPDEELLSCSSFSRSGKRRGERMEAQGGKLVCRAHNAFGGEGVYAIARCCLLPQANCSVHTAPPAEASMGTRVHCHQQGHVLTGCSSHWEVEDLGTHKPPVLRPRGQPNQCVGHREASIHASCCHAPGLECKVKEHGIPAPQEQVTVACEEGWTLTGCSALPGTSHVLGAYAVDNTCVVRSRDVSTTGSTSEGAVTAVAICCRSRHLAQASQELQ

SEQ ID NO: 9 - protein, 540 aa, Homo sapiens
SIPWNLERITPPRYRADEYQPPDGGSLVEVYLLDTSIQSDHREIEGRVMVTDFENVPEEDGTRFHRQASKCDSHGTHLAGVVSGRDAGVAKGASMRSLRVLNCQGKGTVSGTLIGLEFIRKSQLVQPVGPLVVLLPLAGGYSRVLNAACQRLARAGVVLVTAAGNFRDDACLYSPASAPEVITVGATNAQDQPVTLGTLGTNFGRCVDLFAPGEDIIGASSDCSTCFVSQSGTSQAAAHVAGIAAMMLSAEPELTLAELRQRLIHFSAKDVINEAWFPEDQRVLTPNLVAALPPSTHGAGWQLFCRTVWSAHSGPTRMATAIARCAPDEELLSCSSFSRSGKRRGERMEAQGGKLVCRAHNAFGGEGVYAIARCCLLPQANCSVHTAPPAEASMGTRVHCHQQGHVLTGCSSHWEVEDLGTHKPPVLRPRGQPNQCVGHREASIHASCCHAPGLECKVKEHGIPAPQEQVTVACEEGWTLTGCSALPGTSHVLGAYAVDNTCVVRSRDVSTTGSTSEGAVTAVAICCRSRHLAQASQELQ

SEQ ID NO: 10 - protein, 692 aa, Homo sapiens
MGTVSSRRSWWPLPLLLLLLLLLGPAGARAQEDEDGDYEELVLALRSEEDGLAEAPEHGTTATFHRCAKDPWRLPGTYVVVLKEETHLSQSERTARRLQAQAARRGYLTKILHVFHGLLPGFLVKMSGDLLELALKLPHVDYIEEDSSVFAQSIPWNLERITPPRYRADEYQPPDGGSLVEVYLLDTSIQSDHREIEGRVMVTDFENVPEEDGTRFHRQASKCDSHGTHLAGVVSGRDAGVAKGASMRSLRVLNCQGKGTVSGTLIGLEFIRKSQLVQPVGPLVVLLPLAGGYSRVLNAACQRLARAGVVLVTAAGNFRDDACLYSPASAPEVITVGATNAQDQPVTLGTLGTNFGRCVDLFAPGEDIIGASSDCSTCFVSQSGTSQAAAHVAGIAAMMLSAEPELTLAELRQRLIHFSAKDVINEAWFPEDQRVLTPNLVAALPPSTHGAGWQLFCRTVWSAHSGPTRMATAVARCAPDEELLSCSSFSRSGKRRGERMEAQGGKLVCRAHNAFGGEGVYAIARCCLLPQANCSVHTAPPAEASMGTRVHCHQQGHVLTGCSSHWEVEDLGTHKPPVLRPRGQPNQCVGHREASIHASCCHAPGLECKVKEHGIPAPQEQVTVACEEGWTLTGCSALPGTSHVLGAYAVDNTCVVRSRDVSTTGSTSEGAVTAVAICCRSRHLAQASQELQ

SEQ ID NO: 11 - protein, 662 aa, Homo sapiens
QEDEDGDYEELVLALRSEEDGLAEAPEHGTTATFHRCAKDPWRLPGTYVVVLKEETHLSQSERTARRLQAQAARRGYLTKILHVFHGLLPGFLVKMSGDLLELALKLPHVDYIEEDSSVFAQSIPWNLERITPPRYRADEYQPPDGGSLVEVYLLDTSIQSDHREIEGRVMVTDFENVPEEDGTRFHRQASKCDSHGTHLAGVVSGRDAGVAKGASMRSLRVLNCQGKGTVSGTLIGLEFIRKSQLVQPVGPLVVLLPLAGGYSRVLNAACQRLARAGVVLVTAAGNFRDDACLYSPASAPEVITVGATNAQDQPVTLGTLGTNFGRCVDLFAPGEDIIGASSDCSTCFVSQSGTSQAAAHVAGIAAMMLSAEPELTLAELRQRLIHFSAKDVINEAWFPEDQRVLTPNLVAALPPSTHGAGWQLFCRTVWSAHSGPTRMATAVARCAPDEELLSCSSFSRSGKRRGERMEAQGGKLVCRAHNAFGGEGVYAIARCCLLPQANCSVHTAPPAEASMGTRVHCHQQGHVLTGCSSHWEVEDLGTHKPPVLRPRGQPNQCVGHREASIHASCCHAPGLECKVKEHGIPAPQEQVTVACEEGWTLTGCSALPGTSHVLGAYAVDNTCVVRSRDVSTTGSTSEGAVTAVAICCRSRHLAQASQELQ

SEQ ID NO: 12 - protein, 540 aa, Homo sapiens
SIPWNLERITPPRYRADEYQPPDGGSLVEVYLLDTSIQSDHREIEGRVMVTDFENVPEEDGTRFHRQASKCDSHGTHLAGVVSGRDAGVAKGASMRSLRVLNCQGKGTVSGTLIGLEFIRKSQLVQPVGPLVVLLPLAGGYSRVLNAACQRLARAGVVLVTAAGNFRDDACLYSPASAPEVITVGATNAQDQPVTLGTLGTNFGRCVDLFAPGEDIIGASSDCSTCFVSQSGTSQAAAHVAGIAAMMLSAEPELTLAELRQRLIHFSAKDVINEAWFPEDQRVLTPNLVAALPPSTHGAGWQLFCRTVWSAHSGPTRMATAVARCAPDEELLSCSSFSRSGKRRGERMEAQGGKLVCRAHNAFGGEGVYAIARCCLLPQANCSVHTAPPAEASMGTRVHCHQQGHVLTGCSSHWEVEDLGTHKPPVLRPRGQPNQCVGHREASIHASCCHAPGLECKVKEHGIPAPQEQVTVACEEGWTLTGCSALPGTSHVLGAYAVDNTCVVRSRDVSTTGSTSEGAVTAVAICCRSRHLAQASQELQ

SEQ ID NO: 13 - protein, 692 aa, Homo sapiens [sequence omitted]

SEQ ID NO: 14 - protein, 662 aa, Homo sapiens
QEDEDGDYEELVLALRSEEDGLVEAPEHGTTATFHRCAKDPWRLPGTYVVVLKEETHLSQSERTARRLQAQAARRGYLTKILHVFHGLLPGFLVKMSGDLLELALKLPHVDYIEEDSSVFAQSIPWNLERITPPRYRADEYQPPDGGSLVEVYLLDTSIQSDHREIEGRVMVTDFENVPEEDGTRFHRQASKCDSHGTHLAGVVSGRDAGVAKGASMRSLRVLNCQGKGTVSGTLIGLEFIRKSQLVQPVGPLVVLLPLAGGYSRVLNAACQRLARAGVVLVTAAGNFRDDACLYSPASAPEVITVGATNAQDQPVTLGTLGTNFGRCVDLFAPGEDIIGASSDCSTCFVSQSGTSQAAAHVAGIAAMMLSAEPELTLAELRQRLIHFSAKDVINEAWFPEDQRVLTPNLVAALPPSTHGAGWQLFCRTVWSAHSGPTRMATAVARCAPDEELLSCSSFSRSGKRRGERMEAQGGKLVCRAHNAFGGEGVYAIARCCLLPQANCSVHTAPPAEASMGTRVHCHQQGHVLTGCSSHWEVEDLGTHKPPVLRPRGQPNQCVGHREASIHASCCHAPGLECKVKEHGIPAPQEQVTVACEEGWTLTGCSALPGTSHVLGAYAVDNTCVVRSRDVSTTGSTSEEAVTAVAICCRSRHLAQASQELQ

SEQ ID NO: 15 - protein, 692 aa, Homo sapiens
MGTVSSRRSWWPLPLLLLLLLLLGPAGARAQEDEDGDYEELVLALRSEEDGLAEAPEHGTTATFHRCAKDPWRLPGTYVVVLKEETHLSQSERTARRLQAQAARRGYLTKILHVFHGLLPGFLVKMSGDLLELALKLPHVDYIEEDSSVFAQSIPWNLERITPPRYRADEYQPPDGGSLVEVYLLDTSIQSDHREIEGRVMVTDFENVPEEDGTRFHRQASKCDSHGTHLAGVVSGRDAGVAKGASMRSLRVLNCQGKGTVSGTLIGLEFIRKSQLVQPVGPLVVLLPLAGGYSRVLNAACQRLARAGVVLVTAAGNFRDDACLYSPASAPEVITVGATNAQDQPVTLGTLGTNFGRCVDLFAPGEDIIGASSDCSTCFVSQSGTSQAAAHVAGIAAMMLSAEPELTLAELRQRLIHFSAKDVINEAWFPEDQRVLTPNLVATLPPSTHGAGWQLFCRTVWSAHSGPTRMATAIARCAPDEELLSCSSFSRSGKRRGERMEAQGGKLVCRAHNAFGGEGVYAIARCCLLPQANCSVHTAPPAEASMGTRVHCHQQGHVLTGCSSHWEVEDLGTHKPPVLRPRGQPNQCVGHREASIHASCCHAPGLECKVKEHGIPAPQEQVTVACEEGWTLTGCSALPGTSHVLGAYAVDNTCVVRSRDVSTTGSTSEEAVTAVAICCRSRHLAQASQELQ

SEQ ID NO: 16 - protein, 662 aa, Homo sapiens
QEDEDGDYEELVLALRSEEDGLAEAPEHGTTATFHRCAKDPWRLPGTYVVVLKEETHLSQSERTARRLQAQAARRGYLTKILHVFHGLLPGFLVKMSGDLLELALKLPHVDYIEEDSSVFAQSIPWNLERITPPRYRADEYQPPDGGSLVEVYLLDTSIQSDHREIEGRVMVTDFENVPEEDGTRFHRQASKCDSHGTHLAGVVSGRDAGVAKGASMRSLRVLNCQGKGTVSGTLIGLEFIRKSQLVQPVGPLVVLLPLAGGYSRVLNAACQRLARAGVVLVTAAGNFRDDACLYSPASAPEVITVGATNAQDQPVTLGTLGTNFGRCVDLFAPGEDIIGASSDCSTCFVSQSGTSQAAAHVAGIAAMMLSAEPELTLAELRQRLIHFSAKDVINEAWFPEDQRVLTPNLVATLPPSTHGAGWQLFCRTVWSAHSGPTRMATAIARCAPDEELLSCSSFSRSGKRRGERMEAQGGKLVCRAHNAFGGEGVYAIARCCLLPQANCSVHTAPPAEASMGTRVHCHQQGHVLTGCSSHWEVEDLGTHKPPVLRPRGQPNQCVGHREASIHASCCHAPGLECKVKEHGIPAPQEQVTVACEEGWTLTGCSALPGTSHVLGAYAVDNTCVVRSRDVSTTGSTSEEAVTAVAICCRSRHLAQASQELQ

SEQ ID NO: 17 - protein, 540 aa, Homo sapiens
SIPWNLERITPPRYRADEYQPPDGGSLVEVYLLDTSIQSDHREIEGRVMVTDFENVPEEDGTRFHRQASKCDSHGTHLAGVVSGRDAGVAKGASMRSLRVLNCQGKGTVSGTLIGLEFIRKSQLVQPVGPLVVLLPLAGGYSRVLNAACQRLARAGVVLVTAAGNFRDDACLYSPASAPEVITVGATNAQDQPVTLGTLGTNFGRCVDLFAPGEDIIGASSDCSTCFVSQSGTSQAAAHVAGIAAMMLSAEPELTLAELRQRLIHFSAKDVINEAWFPEDQRVLTPNLVATLPPSTHGAGWQLFCRTVWSAHSGPTRMATAIARCAPDEELLSCSSFSRSGKRRGERMEAQGGKLVCRAHNAFGGEGVYAIARCCLLPQANCSVHTAPPAEASMGTRVHCHQQGHVLTGCSSHWEVEDLGTHKPPVLRPRGQPNQCVGHREASIHASCCHAPGLECKVKEHGIPAPQEQVTVACEEGWTLTGCSALPGTSHVLGAYAVDNTCVVRSRDVSTTGSTSEEAVTAVAICCRSRHLAQASQELQ

SEQ ID NO: 18 - protein, 692 aa, Homo sapiens
MGTVSSRRSWWPLPLLLLLLLLLGPAGARAQEDEDGDYEELVLALRSEEDGLAEAPEHGTTATFHRCAKDPWRLPGTYVVVLKEETHLSQSERTARRLQAQAARRGYLTKILHVFHGLLPGFLVKMSGDLLELALKLPHVDYIEEDSSVFAQSIPWNLERITPPRYRADEYQPPDGGSLVEVYLLDTSIQSDHREIEGRVMVTDFENVPEEDGTRFHRQASKCDSHGTHLAGVVSGRDAGVAKGASMRSLRVLNCQGKGTVSGTLIGLEFIRKSQLVQPVGPLVVLLPLAGGYSRVLNAACQRLARAGVVLVTAAGNFRDDACLYSPASAPEVITVGATNAQDQPVTLGTLGTNFGRCVDLFAPGEDIIGASSDCSTCFVSQSGTSQAAAHVAGIAAMMLSAEPELTLAELRQRLIHFSAKDVISEAWFPEDQRVLTPNLVAALPPSTHGAGWQLFCRTVWSAHSGPTRMATAVARCAPDEELLSCSSFSRSGKRRGERMEAQGGKLVCRAHNAFGGEGVYAIARCCLLPQANCSVHTAPPAEASMGTRVHCHQQGHVLTGCSSHWEVEDLGTHKPPVLRPRGQPNQCVGHREASIHASCCHAPGLECKVKEHGIPAPQEQVTVACEEGWTLTGCSALPGTSHVLGAYAVDNTCVVRSRDVSTTGSTSEEAVTAVAICCRSRHLAQASQELQ

SEQ ID NO: 19 - protein, 662 aa, Homo sapiens
QEDEDGDYEELVLALRSEEDGLAEAPEHGTTATFHRCAKDPWRLPGTYVVVLKEETHLSQSERTARRLQAQAARRGYLTKILHVFHGLLPGFLVKMSGDLLELALKLPHVDYIEEDSSVFAQSIPWNLERITPPRYRADEYQPPDGGSLVEVYLLDTSIQSDHREIEGRVMVTDFENVPEEDGTRFHRQASKCDSHGTHLAGVVSGRDAGVAKGASMRSLRVLNCQGKGTVSGTLIGLEFIRKSQLVQPVGPLVVLLPLAGGYSRVLNAACQRLARAGVVLVTAAGNFRDDACLYSPASAPEVITVGATNAQDQPVTLGTLGTNFGRCVDLFAPGEDIIGASSDCSTCFVSQSGTSQAAAHVAGIAAMMLSAEPELTLAELRQRLIHFSAKDVISEAWFPEDQRVLTPNLVAALPPSTHGAGWQLFCRTVWSAHSGPTRMATAVARCAPDEELLSCSSFSRSGKRRGERMEAQGGKLVCRAHNAFGGEGVYAIARCCLLPQANCSVHTAPPAEASMGTRVHCHQQGHVLTGCSSHWEVEDLGTHKPPVLRPRGQPNQCVGHREASIHASCCHAPGLECKVKEHGIPAPQEQVTVACEEGWTLTGCSALPGTSHVLGAYAVDNTCVVRSRDVSTTGSTSEEAVTAVAICCRSRHLAQASQELQ

SEQ ID NO: 20 - protein, 540 aa, Homo sapiens
SIPWNLERITPPRYRADEYQPPDGGSLVEVYLLDTSIQSDHREIEGRVMVTDFENVPEEDGTRFHRQASKCDSHGTHLAGVVSGRDAGVAKGASMRSLRVLNCQGKGTVSGTLIGLEFIRKSQLVQPVGPLVVLLPLAGGYSRVLNAACQRLARAGVVLVTAAGNFRDDACLYSPASAPEVITVGATNAQDQPVTLGTLGTNFGRCVDLFAPGEDIIGASSDCSTCFVSQSGTSQAAAHVAGIAAMMLSAEPELTLAELRQRLIHFSAKDVISEAWFPEDQRVLTPNLVAALPPSTHGAGWQLFCRTVWSAHSGPTRMATAVARCAPDEELLSCSSFSRSGKRRGERMEAQGGKLVCRAHNAFGGEGVYAIARCCLLPQANCSVHTAPPAEASMGTRVHCHQQGHVLTGCSSHWEVEDLGTHKPPVLRPRGQPNQCVGHREASIHASCCHAPGLECKVKEHGIPAPQEQVTVACEEGWTLTGCSALPGTSHVLGAYAVDNTCVVRSRDVSTTGSTSEEAVTAVAICCRSRHLAQASQELQ

SEQ ID NO: 21 - protein, 692 aa, Homo sapiens
MGTVSSRRSWWPLPLLLLLLLLLGPAGARAQEDEDGDYEELVLALRSEEDGLAEAPEHGTTATFHRCAKDPWRLPGTYVVVLKEETHLSQSERTARRLQAQAARRGYLTKILHVFHGLLPGFLVKMSGDLLELALKLPHVDYIEEDSSVFAQSIPWNLERITPPRYRADEYQPPDGGSLVEVYLLDTSIQSDHREIEGRVMVTDFENVPEEDGTRFHRQASKCDSHGTHLAGVVSGRDAGVAKGASMRSLRVLNCQGKGTVSGTLIGLEFIRKSQLVQPVGPLVVLLPLAGGYSRVLNAACQRLARAGVVLVTAAGNFRDDACLYSPASAPEVITVGATNAQDQPVTLGTLGTNFGRCVDLFAPGEDIIGASSDCSTCFVSQSGTSQAAAHVAGIAAMMLSAEPELTLAELRQRLIHFSAKDVINEAWFPEDQRVLTPNLVATLPPSTHGAGWQLFCRTVWSAHSGPTRMATAIARCAPDEELLSCSSFSRSGKRRGERMEAQGGKLVCRAHNAFGGEGVYAIARCCLLPQANCSVHTAPPAEASMGTRVHCHQQGHVLTGCSSHWEVEDLGTHKPPVLRPRGQPNQCVGHREASIHASCCHAPGLECKVKEHGIPAPPEQVTVACEEGWTLTGCSALPGTSHVLGAYAVDNTCVVRSRDVSTTGSTSEEAVTAVAICCRSRHLAQASQELQ

SEQ ID NO: 22 - protein, 662 aa, Homo sapiens
QEDEDGDYEELVLALRSEEDGLAEAPEHGTTATFHRCAKDPWRLPGTYVVVLKEETHLSQSERTARRLQAQAARRGYLTKILHVFHGLLPGFLVKMSGDLLELALKLPHVDYIEEDSSVFAQSIPWNLERITPPRYRADEYQPPDGGSLVEVYLLDTSIQSDHREIEGRVMVTDFENVPEEDGTRFHRQASKCDSHGTHLAGVVSGRDAGVAKGASMRSLRVLNCQGKGTVSGTLIGLEFIRKSQLVQPVGPLVVLLPLAGGYSRVLNAACQRLARAGVVLVTAAGNFRDDACLYSPASAPEVITVGATNAQDQPVTLGTLGTNFGRCVDLFAPGEDIIGASSDCSTCFVSQSGTSQAAAHVAGIAAMMLSAEPELTLAELRQRLIHFSAKDVINEAWFPEDQRVLTPNLVATLPPSTHGAGWQLFCRTVWSAHSGPTRMATAIARCAPDEELLSCSSFSRSGKRRGERMEAQGGKLVCRAHNAFGGEGVYAIARCCLLPQANCSVHTAPPAEASMGTRVHCHQQGHVLTGCSSHWEVEDLGTHKPPVLRPRGQPNQCVGHREASIHASCCHAPGLECKVKEHGIPAPPEQVTVACEEGWTLTGCSALPGTSHVLGAYAVDNTCVVRSRDVSTTGSTSEEAVTAVAICCRSRHLAQASQELQ

SEQ ID NO: 23 - protein, 540 aa, Homo sapiens
SIPWNLERITPPRYRADEYQPPDGGSLVEVYLLDTSIQSDHREIEGRVMVTDFENVPEEDGTRFHRQASKCDSHGTHLAGVVSGRDAGVAKGASMRSLRVLNCQGKGTVSGTLIGLEFIRKSQLVQPVGPLVVLLPLAGGYSRVLNAACQRLARAGVVLVTAAGNFRDDACLYSPASAPEVITVGATNAQDQPVTLGTLGTNFGRCVDLFAPGEDIIGASSDCSTCFVSQSGTSQAAAHVAGIAAMMLSAEPELTLAELRQRLIHFSAKDVINEAWFPEDQRVLTPNLVATLPPSTHGAGWQLFCRTVWSAHSGPTRMATAIARCAPDEELLSCSSFSRSGKRRGERMEAQGGKLVCRAHNAFGGEGVYAIARCCLLPQANCSVHTAPPAEASMGTRVHCHQQGHVLTGCSSHWEVEDLGTHKPPVLRPRGQPNQCVGHREASIHASCCHAPGLECKVKEHGIPAPPEQVTVACEEGWTLTGCSALPGTSHVLGAYAVDNTCVVRSRDVSTTGSTSEEAVTAVAICCRSRHLAQASQELQ

SEQ ID NO: 24 - protein, 692 aa, Homo sapiens
MGTVSSRRSWWPLPLLLLLLLLLGPAGARAQEDEDGDYEELVLALLSEEDGLAEAPEHGTTATFHRCAKDPWRLPGTYVVVLKEETHLSQSERTARRLQAQAARRGYLTKILHVFHGLLPGFLVKMSGDLLELALKLPHVDYIEEDSSVFAQSIPWNLERITPPRYRADEYQPPDGGSLVEVYLLDTSIQSDHREIEGRVMVTDFENVPEEDGTRFHRQASKCDSHGTHLAGVVSGRDAGVAKGASMRSLRVLNCQGKGTVSGTLIGLEFIRKSQLVQPVGPLVVLLPLAGGYSRVLNAACQRLARAGVVLVTAAGNFRDDACLYSPASAPEVITVGATNAQDQPVTLGTLGTNFGRCVDLFAPGEDIIGASSDCSTCFVSQSGTSQAAAHVAGIAAMMLSAEPELTLAELRQRLIHFSAKDVINEAWFPEDQRVLTPNLVAALPPSTHGAGWQLFCRTVWSAHSGPTRMATAVARCAPDEELLSCSSFSRSGKRRGERMEAQGGKLVCRAHNAFGGEGVYAIARCCLLPQANCSVHTAPPAEASMGTRVHCHQQGHVLTGCSSHWEVEDLGTHKPPVLRPRGQPNQCVGHREASIHASCCHAPGLECKVKEHGIPAPQEQVTVACEEGWTLTGCSALPGTSHVLGAYAVDNTCVVRSRDVSTTGSTSEEAVTAVAICCRSRHLAQASQELQ

SEQ ID NO: 25 - protein, 662 aa, Homo sapiens
QEDEDGDYEELVLALLSEEDGLAEAPEHGTTATFHRCAKDPWRLPGTYVVVLKEETHLSQSERTARRLQAQAARRGYLTKILHVFHGLLPGFLVKMSGDLLELALKLPHVDYIEEDSSVFAQSIPWNLERITPPRYRADEYQPPDGGSLVEVYLLDTSIQSDHREIEGRVMVTDFENVPEEDGTRFHRQASKCDSHGTHLAGVVSGRDAGVAKGASMRSLRVLNCQGKGTVSGTLIGLEFIRKSQLVQPVGPLVVLLPLAGGYSRVLNAACQRLARAGVVLVTAAGNFRDDACLYSPASAPEVITVGATNAQDQPVTLGTLGTNFGRCVDLFAPGEDIIGASSDCSTCFVSQSGTSQAAAHVAGIAAMMLSAEPELTLAELRQRLIHFSAKDVINEAWFPEDQRVLTPNLVAALPPSTHGAGWQLFCRTVWSAHSGPTRMATAVARCAPDEELLSCSSFSRSGKRRGERMEAQGGKLVCRAHNAFGGEGVYAIARCCLLPQANCSVHTAPPAEASMGTRVHCHQQGHVLTGCSSHWEVEDLGTHKPPVLRPRGQPNQCVGHREASIHASCCHAPGLECKVKEHGIPAPQEQVTVACEEGWTLTGCSALPGTSHVLGAYAVDNTCVVRSRDVSTTGSTSEEAVTAVAICCRSRHLAQASQELQ

SEQ ID NO: 26 - protein, 692 aa, Homo sapiens [sequence omitted]

SEQ ID NO: 27 - protein, 662 aa, Homo sapiens
QEDEDGDYEELVLALRSEEDGLVEAPEHGTTATFHRCAKDPWRLPGTYVVVLKEETHLSQSERTARRLQAQAARRGYLTKILHVFHGLLPGFLVKMSGDLLELALKLPHVDYIEEDSSVFAQSIPWNLERITPPRYRADEYQPPDGGSLVEVYLLDTSIQSDHREIEGRVMVTDFENVPEEDGTRFHRQASKCDSHGTHLAGVVSGRDAGVAKGASMRSLRVLNCQGKGTVSGTLIGLEFIRKSQLVQPVGPLVVLLPLAGGYSRVLNAACQRLARAGVVLVTAAGNFRDDACLYSPASAPEVITVGATNAQDQPVTLGTLGTNFGRCVDLFAPGEDIIGASSDCSTCFVSQSGTSQAAAHVAGIAAMMLSAEPELTLAELRQRLIHFSAKDVINEAWFPEDQRVLTPNLVAALPPSTHGAGWQLFCRTVWSAHSGPTRMATAIARCAPDEELLSCSSFSRSGKRRGERMEAQGGKLVCRAHNAFGGEGVYAIARCCLLPQANCSVHTAPPAEASMGTRVHCHQQGHVLTGCSSHWEVEDLGTHKPPVLRPRGQPNQCVGHREASIHASCCHAPGLECKVKEHGIPAPQEQVTVACEEGWTLTGCSALPGTSHVLGAYAVDNTCVVRSRDVSTTGSTSEGAVTAVAICCRSRHLAQASQELQ

SEQ ID NO: 28 - DNA, 2080 bp, Homo sapiens
atgggcaccgtcagctccaggcggtcctggtggccgctgccactgctgctgctgctgctgctgctcctgggtcccgcgggcgcccgtgcgcaggaggacgaggacggcgactacgaggagctggtgctagccttgcgttccgaggaggacggcctggccgaagcacccgagcacggaaccacagccaccttccaccgctgcgccaaggatccgtggaggttgcctggcacctacgtggtggtgctgaaggaggagacccacctctcgcagtcagagcgcactgcccgccgcctgcaggcccaggctgcccgccggggatacctcaccaagatcctgcatgtcttccatggccttcttcctggcttcctggtgaagatgagtggcgacctgctggagctggccttgaagttgccccatgtcgactacatcgaggaggactcctctgtctttgcccagagcatcccgtggaacctggagcggattacccctccacggtaccgggcggatgaataccagccccccgacggaggcagcctggtggaggtgtatctcctagacaccagcatacagagtgaccaccgggaaatcgagggcagggtcatggtcaccgacttcgagaatgtgcccgaggaggacgggacccgcttccacagacaggccagcaagtgtgacagtcatggcacccacctggcaggggtggtcagcggccgggatgccggcgtggccaagggtgccagcatgcgcagcctgcgcgtgctcaactgccaagggaagggcacggttagcggcaccctcataggcctggagtttattcggaaaagccagctggtccagcctgtggggccactggtggtgctgctgcccctggcgggtgggtacagccgcgtcctcaacgccgcctgccagcgcctggcgagggctggggtcgtgctggtcaccgctgccggcaacttccgggacgatgcctgcctctactccccagcctcagctcccgaggtcatcacagttggggccaccaatgcccaagaccagccggtgaccctggggactttggggaccaactttggccgctgtgtggacctctttgccccaggggaggacatcattggtgcctccagcgactgcagcacctgctttgtgtcacagagtgggacatcacaggctgctgcccacgtggctggcattgcagccatgatgctgtctgccgagccggagctcaccctggccgagttgaggcagagactgatccacttctctgccaaagatgtcatcaatgaggcctggttccctgaggaccagcgggtactgacccccaacctggtggccgccctgccccccagcacccatggggcaggttggcagctgttttgcaggactgtatggtcagcacactcggggcctacacggatggccacagccatcgcccgctgcgccccagatgaggagctgctgagctgctccagtttctccaggagtgggaagcggcggggcgagcgcatggaggcccaagggggcaagctggtctgccgggcccacaacgcttttgggggtgagggtgtctacgccattgccaggtgctgcctgctaccccaggccaactgcagcgtccacacagctccaccagctgaggccagcatggggacccgtgtccactgccaccaacagggccacgtcctcacaggctgcagctcccactgggaggtggaggaccttggcacccacaagccgcctgtgctgaggccacgaggtcagcccaaccagtgcgtgggccacagggaggccagcatccacgcttcctgctgccatgccccaggtctggaatgcaaagtcaaggagcatggaatcccggcccctcaggagcaggtgaccgtggcctgcgaggagggctggaccctgactggctgcagtgccctccctgggacctcccacgtcctgggggcctacgccgtagacaacacgtgtgtagtcaggagccgggacgtcagcactacaggcagcaccagcgaagaggccgtgacagccgttgccatctgctgccggagccggcacctggcgcaggcctcccaggagctccagtgac

SEQ ID NO: 29 - DNA, 2080 bp, Homo sapiens
atgggcaccgtcagctccaggcggtcctggtggccgctgccactgctgctgctgctgctgctgctcctgggtcccgcgggcgcccgtgcgcaggaggacgaggacggcgactacgaggagctggtgctagccttgcgttccgaggaggacggcctggccgaagcacccgagcacggaaccacagccaccttccaccgctgcgccaaggatccgtggaggttgcctggcacctacgtggtggtgctgaaggaggagacccacctctcgcagtcagagcgcactgcccgccgcctgcaggcccaggctgcccgccggggatacctcaccaagatcctgcatgtcttccatggccttcttcctggcttcctggtgaagatgagtggcgacctgctggagctggccttgaagttgccccatgtcgactacatcgaggaggactcctctgtctttgcccagagcatcccgtggaacctggagcggattacccctccacggtaccgggcggatgaataccagccccccgacggaggcagcctggtggaggtgtatctcctagacaccagcatacagagtgaccaccgggaaatcgagggcagggtcatggtcaccgacttcgagaatgtgcccgaggaggacgggacccgcttccacagacaggccagcaagtgtgacagtcatggcacccacctggcaggggtggtcagcggccgggatgccggcgtggccaagggtgccagcatgcgcagcctgcgcgtgctcaactgccaagggaagggcacggttagcggcaccctcataggcctggagtttattcggaaaagccagctggtccagcctgtggggccactggtggtgctgctgcccctggcgggtgggtacagccgcgtcctcaacgccgcctgccagcgcctggcgagggctggggtcgtgctggtcaccgctgccggcaacttccgggacgatgcctgcctctactccccagcctcagctcccgaggtcatcacagttggggccaccaatgcccaagaccagccggtgaccctggggactttggggaccaactttggccgctgtgtggacctctttgccccaggggaggacatcattggtgcctccagcgactgcagcacctgctttgtgtcacagagtgggacatcacaggctgctgcccacgtggctggcattgcagccatgatgctgtctgccgagccggagctcaccctggccgagttgaggcagagactgatccacttctctgccaaagatgtcatcaatgaggcctggttccctgaggaccagcgggtactgacccccaacctggtggccgccctgccccccagcacccatggggcaggttggcagctgttttgcaggactgtatggtcagcacactcggggcctacacggatggccacagccgtcgcccgctgcgccccagatgaggagctgctgagctgctccagtttctccaggagtgggaagcggcggggcgagcgcatggaggcccaagggggcaagctggtctgccgggcccacaacgcttttgggggtgagggtgtctacgccattgccaggtgctgcctgctaccccaggccaactgcagcgtccacacagctccaccagctgaggccagcatggggacccgtgtccactgccaccaacagggccacgtcctcacaggctgcagctcccactgggaggtggaggaccttggcacccacaagccgcctgtgctgaggccacgaggtcagcccaaccagtgcgtgggccacagggaggccagcatccacgcttcctgctgccatgccccaggtctggaatgcaaagtcaaggagcatggaatcccggcccctcaggagcaggtgaccgtggcctgcgaggagggctggaccctgactggctgcagtgccctccctgggacctcccacgtcctgggggcctacgccgtagacaacacgtgtgtagtcaggagccgggacgtcagcactacaggcagcaccagcgaagaggccgtgacagccgttgccatctgctgccggagccggcacctggcgcaggcctcccaggagctccagtgac

SEQ ID NO: 30 - DNA, 2080 bp, Homo sapiens
atgggcaccgtcagctccaggcggtcctggtggccgctgccactgctgctgctgctgctgctgctcctgggtcccgcgggcgcccgtgcgcaggaggacgaggacggcgactacgaggagctggtgctagccttgcgttccgaggaggacggcctggccgaagcacccgagcacggaaccacagccaccttccaccgctgcgccaaggatccgtggaggttgcctggcacctacgtggtggtgctgaaggaggagacccacctctcgcagtcagagcgcactgcccgccgcctgcaggcccaggctgcccgccggggatacctcaccaagatcctgcatgtcttccatggccttcttcctggcttcctggtgaagatgagtggcgacctgctggagctggccttgaagttgccccatgtcgactacatcgaggaggactcctctgtctttgcccagagcatcccgtggaacctggagcggattacccctccacggtaccgggcggatgaataccagccccccgacggaggcagcctggtggaggtgtatctcctagacaccagcatacagagtgaccaccgggaaatcgagggcagggtcatggtcaccgacttcgagaatgtgcccgaggaggacgggacccgcttccacagacaggccagcaagtgtgacagtcatggcacccacctggcaggggtggtcagcggccgggatgccggcgtggccaagggtgccagcatgcgcagcctgcgcgtgctcaactgccaagggaagggcacggttagcggcaccctcataggcctggagtttattcggaaaagccagctggtccagcctgtggggccactggtggtgctgctgcccctggcgggtgggtacagccgcgtcctcaacgccgcctgccagcgcctggcgagggctggggtcgtgctggtcaccgctgccggcaacttccgggacgatgcctgcctctactccccagcctcagctcccgaggtcatcacagttggggccaccaatgcccaagaccagccggtgaccctggggactttggggaccaactttggccgctgtgtggacctctttgccccaggggaggacatcattggtgcctccagcgactgcagcacctgctttgtgtcacagagtgggacatcacaggctgctgcccacgtggctggcattgcagccatgatgctgtctgccgagccggagctcaccctggccgagttgaggcagagactgatccacttctctgccaaagatgtcatcaatgaggcctggttccctgaggaccagcgggtactgacccccaacctggtggccgccctgccccccagcacccatggggcaggttggcagctgttttgcaggactgtatggtcagcacactcggggcctacacggatggccacagccatcgcccgctgcgccccagatgaggagctgctgagctgctccagtttctccaggagtgggaagcggcggggcgagcgcatggaggcccaagggggcaagctggtctgccgggcccacaacgcttttgggggtgagggtgtctacgccattgccaggtgctgcctgctaccccaggccaactgcagcgtccacacagctccaccagctgaggccagcatggggacccgtgtccactgccaccaacagggccacgtcctcacaggctgcagctcccactgggaggtggaggaccttggcacccacaagccgcctgtgctgaggccacgaggtcagcccaaccagtgcgtgggccacagggaggccagcatccacgcttcctgctgccatgccccaggtctggaatgcaaagtcaaggagcatggaatcccggcccctcaggagcaggtgaccgtggcctgcgaggagggctggaccctgactggctgcagtgccctccctgggacctcccacgtcctgggggcctacgccgtagacaacacgtgtgtagtcaggagccgggacgtcagcactacaggcagcaccagcgaaggggccgtgacagccgttgccatctgctgccggagccggcacctggcgcaggcctcccaggagctccagtgac

SEQ ID NO: 31 - DNA, 2080 bp, Homo sapiens
atgggcaccgtcagctccaggcggtcctggtggccgctgccactgctgctgctgctgctgctgctcctgggtcccgcgggcgcccgtgcgcaggaggacgaggacggcgactacgaggagctggtgctagccttgcgttccgaggaggacggcctggccgaagcacccgagcacggaaccacagccaccttccaccgctgcgccaaggatccgtggaggttgcctggcacctacgtggtggtgctgaaggaggagacccacctctcgcagtcagagcgcactgcccgccgcctgcaggcccaggctgcccgccggggatacctcaccaagatcctgcatgtcttccatggccttcttcctggcttcctggtgaagatgagtggcgacctgctggagctggccttgaagttgccccatgtcgactacatcgaggaggactcctctgtctttgcccagagcatcccgtggaacctggagcggattacccctccacggtaccgggcggatgaataccagccccccgacggaggcagcctggtggaggtgtatctcctagacaccagcatacagagtgaccaccgggaaatcgagggcagggtcatggtcaccgacttcgagaatgtgcccgaggaggacgggacccgcttccacagacaggccagcaagtgtgacagtcatggcacccacctggcaggggtggtcagcggccgggatgccggcgtggccaagggtgccagcatgcgcagcctgcgcgtgctcaactgccaagggaagggcacggttagcggcaccctcataggcctggagtttattcggaaaagccagctggtccagcctgtggggccactggtggtgctgctgcccctggcgggtgggtacagccgcgtcctcaacgccgcctgccagcgcctggcgagggctggggtcgtgctggtcaccgctgccggcaacttccgggacgatgcctgcctctactccccagcctcagctcccgaggtcatcacagttggggccaccaatgcccaagaccagccggtgaccctggggactttggggaccaactttggccgctgtgtggacctctttgccccaggggaggacatcattggtgcctccagcgactgcagcacctgctttgtgtcacagagtgggacatcacaggctgctgcccacgtggctggcattgcagccatgatgctgtctgccgagccggagctcaccctggccgagttgaggcagagactgatccacttctctgccaaagatgtcatcaatgaggcctggttccctgaggaccagcgggtactgacccccaacctggtggccgccctgccccccagcacccatggggcaggttggcagctgttttgcaggactgtatggtcagcacactcggggcctacacggatggccacagccgtcgcccgctgcgccccagatgaggagctgctgagctgctccagtttctccaggagtgggaagcggcggggcgagcgcatggaggcccaagggggcaagctggtctgccgggcccacaacgcttttgggggtgagggtgtctacgccattgccaggtgctgcctgctaccccaggccaactgcagcgtccacacagctccaccagctgaggccagcatggggacccgtgtccactgccaccaacagggccacgtcctcacaggctgcagctcccactgggaggtggaggaccttggcacccacaagccgcctgtgctgaggccacgaggtcagcccaaccagtgcgtgggccacagggaggccagcatccacgcttcctgctgccatgccccaggtctggaatgcaaagtcaaggagcatggaatcccggcccctcaggagcaggtgaccgtggcctgcgaggagggctggaccctgactggctgcagtgccctccctgggacctcccacgtcctgggggcctacgccgtagacaacacgtgtgtagtcaggagccgggacgtcagcactacaggcagcaccagcgaaggggccgtgacagccgttgccatctgctgccggagccggcacctggcgcaggcctcccaggagctccagtgac

SEQ ID NO: 32 - DNA, 2080 bp, Homo sapiens
atgggcaccgtcagctccaggcggtcctggtggccgctgccactgctgctgctgctgctgctgctcctgggtcccgcgggcgcccgtgcgcaggaggacgaggacggcgactacgaggagctggtgctagccttgcgttccgaggaggacggcctggtcgaagcacccgagcacggaaccacagccaccttccaccgctgcgccaaggatccgtggaggttgcctggcacctacgtggtggtgctgaaggaggagacccacctctcgcagtcagagcgcactgcccgccgcctgcaggcccaggctgcccgccggggatacctcaccaagatcctgcatgtcttccatggccttcttcctggcttcctggtgaagatgagtggcgacctgctggagctggccttgaagttgccccatgtcgactacatcgaggaggactcctctgtctttgcccagagcatcccgtggaacctggagcggattacccctccacggtaccgggcggatgaataccagccccccgacggaggcagcctggtggaggtgtatctcctagacaccagcatacagagtgaccaccgggaaatcgagggcagggtcatggtcaccgacttcgagaatgtgcccgaggaggacgggacccgcttccacagacaggccagcaagtgtgacagtcatggcacccacctggcaggggtggtcagcggccgggatgccggcgtggccaagggtgccagcatgcgcagcctgcgcgtgctcaactgccaagggaagggcacggttagcggcaccctcataggcctggagtttattcggaaaagccagctggtccagcctgtggggccactggtggtgctgctgcccctggcgggtgggtacagccgcgtcctcaacgccgcctgccagcgcctggcgagggctggggtcgtgctggtcaccgctgccggcaacttccgggacgatgcctgcctctactccccagcctcagctcccgaggtcatcacagttggggccaccaatgcccaagaccagccggtgaccctggggactttggggaccaactttggccgctgtgtggacctctttgccccaggggaggacatcattggtgcctccagcgactgcagcacctgctttgtgtcacagagtgggacatcacaggctgctgcccacgtggctggcattgcagccatgatgctgtctgccgagccggagctcaccctggccgagttgaggcagagactgatccacttctctgccaaagatgtcatcaatgaggcctggttccctgaggaccagcgggtactgacccccaacctggtggccgccctgccccccagcacccatggggcaggttggcagctgttttgcaggactgtatggtcagcacactcggggcctacacggatggccacagccgtcgcccgctgcgccccagatgaggagctgctgagctgctccagtttctccaggagtgggaagcggcggggcgagcgcatggaggcccaagggggcaagctggtctgccgggcccacaacgcttttgggggtgagggtgtctacgccattgccaggtgctgcctgctaccccaggccaactgcagcgtccacacagctccaccagctgaggccagcatggggacccgtgtccactgccaccaacagggccacgtcctcacaggctgcagctcccactgggaggtggaggaccttggcacccacaagccgcctgtgctgaggccacgaggtcagcccaaccagtgcgtgggccacagggaggccagcatccacgcttcctgctgccatgccccaggtctggaatgcaaagtcaaggagcatggaatcccggcccctcaggagcaggtgaccgtggcctgcgaggagggctggaccctgactggctgcagtgccctccctgggacctcccacgtcctgggggcctacgccgtagacaacacgtgtgtagtcaggagccgggacgtcagcactacaggcagcaccagcgaagaggccgtgacagccgttgccatctgctgccggagccggcacctggcgcaggcctcccaggagctccagtgac

SEQ ID NO: 33 - DNA, 2080 bp, Homo sapiens
atgggcaccgtcagctccaggcggtcctggtggccgctgccactgctgctgctgctgctgctgctcctgggtcccgcgggcgcccgtgcgcaggaggacgaggacggcgactacgaggagctggtgctagccttgcgttccgaggaggacggcctggccgaagcacccgagcacggaaccacagccaccttccaccgctgcgccaaggatccgtggaggttgcctggcacctacgtggtggtgctgaaggaggagacccacctctcgcagtcagagcgcactgcccgccgcctgcaggcccaggctgcccgccggggatacctcaccaagatcctgcatgtcttccatggccttcttcctggcttcctggtgaagatgagtggcgacctgctggagctggccttgaagttgccccatgtcgactacatcgaggaggactcctctgtctttgcccagagcatcccgtggaacctggagcggattacccctccacggtaccgggcggatgaataccagccccccgacggaggcagcctggtggaggtgtatctcctagacaccagcatacagagtgaccaccgggaaatcgagggcagggtcatggtcaccgacttcgagaatgtgcccgaggaggacgggacccgcttccacagacaggccagcaagtgtgacagtcatggcacccacctggcaggggtggtcagcggccgggatgccggcgtggccaagggtgccagcatgcgcagcctgcgcgtgctcaactgccaagggaagggcacggttagcggcaccctcataggcctggagtttattcggaaaagccagctggtccagcctgtggggccactggtggtgctgctgcccctggcgggtgggtacagccgcgtcctcaacgccgcctgccagcgcctggcgagggctggggtcgtgctggtcaccgctgccggcaacttccgggacgatgcctgcctctactccccagcctcagctcccgaggtcatcacagttggggccaccaatgcccaagaccagccggtgaccctggggactttggggaccaactttggccgctgtgtggacctctttgccccaggggaggacatcattggtgcctccagcgactgcagcacctgctttgtgtcacagagtgggacatcacaggctgctgcccacgtggctggcattgcagccatgatgctgtctgccgagccggagctcaccctggccgagttgaggcagagactgatccacttctctgccaaagatgtcatcaatgaggcctggttccctgaggaccagcgggtactgacccccaacctggtggccaccctgccccccagcacccatggggcaggttggcagctgttttgcaggactgtatggtcagcacactcggggcctacacggatggccacagccatcgcccgctgcgccccagatgaggagctgctgagctgctccagtttctccaggagtgggaagcggcggggcgagcgcatggaggcccaagggggcaagctggtctgccgggcccacaacgcttttgggggtgagggtgtctacgccattgccaggtgctgcctgctaccccaggccaactgcagcgtccacacagctccaccagctgaggccagcatggggacccgtgtccactgccaccaacagggccacgtcctcacaggctgcagctcccactgggaggtggaggaccttggcacccacaagccgcctgtgctgaggccacgaggtcagcccaaccagtgcgtgggccacagggaggccagcatccacgcttcctgctgccatgccccaggtctggaatgcaaagtcaaggagcatggaatcccggcccctcaggagcaggtgaccgtggcctgcgaggagggctggaccctgactggctgcagtgccctccctgggacctcccacgtcctgggggcctacgccgtagacaacacgtgtgtagtcaggagccgggacgtcagcactacaggcagcaccagcgaagaggccgtgacagccgttgccatctgctgccggagccggcacctggcgcaggcctcccaggagctccagtgac

SEQ ID NO: 34 - DNA, 2080 bp, Homo sapiens
atgggcaccgtcagctccaggcggtcctggtggccgctgccactgctgctgctgctgctgctgctcctgggtcccgcgggcgcccgtgcgcaggaggacgaggacggcgactacgaggagctggtgctagccttgcgttccgaggaggacggcctggccgaagcacccgagcacggaaccacagccaccttccaccgctgcgccaaggatccgtggaggttgcctggcacctacgtggtggtgctgaaggaggagacccacctctcgcagtcagagcgcactgcccgccgcctgcaggcccaggctgcccgccggggatacctcaccaagatcctgcatgtcttccatggccttcttcctggcttcctggtgaagatgagtggcgacctgctggagctggccttgaagttgccccatgtcgactacatcgaggaggactcctctgtctttgcccagagcatcccgtggaacctggagcggattacccctccacggtaccgggcggatgaataccagccccccgacggaggcagcctggtggaggtgtatctcctagacaccagcatacagagtgaccaccgggaaatcgagggcagggtcatggtcaccgacttcgagaatgtgcccgaggaggacgggacccgcttccacagacaggccagcaagtgtgacagtcatggcacccacctggcaggggtggtcagcggccgggatgccggcgtggccaagggtgccagcatgcgcagcctgcgcgtgctcaactgccaagggaagggcacggttagcggcaccctcataggcctggagtttattcggaaaagccagctggtccagcctgtggggccactggtggtgctgctgcccctggcgggtgggtacagccgcgtcctcaacgccgcctgccagcgcctggcgagggctggggtcgtgctggtcaccgctgccggcaacttccgggacgatgcctgcctctactccccagcctcagctcccgaggtcatcacagttggggccaccaatgcccaagaccagccggtgaccctggggactttggggaccaactttggccgctgtgtggacctctttgccccaggggaggacatcattggtgcctccagcgactgcagcacctgctttgtgtcacagagtgggacatcacaggctgctgcccacgtggctggcattgcagccatgatgctgtctgccgagccggagctcaccctggccgagttgaggcagagactgatccacttctctgccaaagatgtcatcagtgaggcctggttccctgaggaccagcgggtactgacccccaacctggtggccgccctgccccccagcacccatggggcaggttggcagctgttttgcaggactgtatggtcagcacactcggggcctacacggatggccacagccgtcgcccgctgcgccccagatgaggagctgctgagctgctccagtttctccaggagtgggaagcggcggggcgagcgcatggaggcccaagggggcaagctggtctgccgggcccacaacgcttttgggggtgagggtgtctacgccattgccaggtgctgcctgctaccccaggccaactgcagcgtccacacagctccaccagctgaggccagcatggggacccgtgtccactgccaccaacagggccacgtcctcacaggctgcagctcccactgggaggtggaggaccttggcacccacaagccgcctgtgctgaggccacgaggtcagcccaaccagtgcgtgggccacagggaggccagcatccacgcttcctgctgccatgccccaggtctggaatgcaaagtcaaggagcatggaatcccggcccctcaggagcaggtgaccgtggcctgcgaggagggctggaccctgactggctgcagtgccctccctgggacctcccacgtcctgggggcctacgccgtagacaacacgtgtgtagtcaggagccgggacgtcagcactacaggcagcaccagcgaagaggccgtgacagccgttgccatctgctgccggagccggcacctggcgcaggcctcccaggagctccagtgac

SEQ ID NO: 35 - DNA, 2080 bp, Homo sapiens
atgggcaccgtcagctccaggcggtcctggtggccgctgccactgctgctgctgctgctgctgctcctgggtcccgcgggcgcccgtgcgcaggaggacgaggacggcgactacgaggagctggtgctagccttgcgttccgaggaggacggcctggccgaagcacccgagcacggaaccacagccaccttccaccgctgcgccaaggatccgtggaggttgcctggcacctacgtggtggtgctgaaggaggagacccacctctcgcagtcagagcgcactgcccgccgcctgcaggcccaggctgcccgccggggatacctcaccaagatcctgcatgtcttccatggccttcttcctggcttcctggtgaagatgagtggcgacctgctggagctggccttgaagttgccccatgtcgactacatcgaggaggactcctctgtctttgcccagagcatcccgtggaacctggagcggattacccctccacggtaccgggcggatgaataccagccccccgacggaggcagcctggtggaggtgtatctcctagacaccagcatacagagtgaccaccgggaaatcgagggcagggtcatggtcaccgacttcgagaatgtgcccgaggaggacgggacccgcttccacagacaggccagcaagtgtgacagtcatggcacccacctggcaggggtggtcagcggccgggatgccggcgtggccaagggtgccagcatgcgcagcctgcgcgtgctcaactgccaagggaagggcacggttagcggcaccctcataggcctggagtttattcggaaaagccagctggtccagcctgtggggccactggtggtgctgctgcccctggcgggtgggtacagccgcgtcctcaacgccgcctgccagcgcctggcgagggctggggtcgtgctggtcaccgctgccggcaacttccgggacgatgcctgcctctactccccagcctcagctcccgaggtcatcacagttggggccaccaatgcccaagaccagccggtgaccctggggactttggggaccaactttggccgctgtgtggacctctttgccccaggggaggacatcattggtgcctccagcgactgcagcacctgctttgtgtcacagagtgggacatcacaggctgctgcccacgtggctggcattgcagccatgatgctgtctgccgagccggagctcaccctggccgagttgaggcagagactgatccacttctctgccaaagatgtcatcaatgaggcctggttccctgaggaccagcgggtactgacccccaacctggtggccaccctgccccccagcacccatggggcaggttggcagctgttttgcaggactgtatggtcagcacactcggggcctacacggatggccacagccatcgcccgctgcgccccagatgaggagctgctgagctgctccagtttctccaggagtgggaagcggcggggcgagcgcatggaggcccaagggggcaagctggtctgccgggcccacaacgcttttgggggtgagggtgtctacgccattgccaggtgctgcctgctaccccaggccaactgcagcgtccacacagctccaccagctgaggccagcatggggacccgtgtccactgccaccaacagggccacgtcctcacaggctgcagctcccactgggaggtggaggaccttggcacccacaagccgcctgtgctgaggccacgaggtcagcccaaccagtgcgtgggccacagggaggccagcatccacgcttcctgctgccatgccccaggtctggaatgcaaagtcaaggagcatggaatcccggcccctccggagcaggtgaccgtggcctgcgaggagggctggaccctgactggctgcagtgccctccctgggacctcccacgtcctgggggcctacgccgtagacaacacgtgtgtagtcaggagccgggacgtcagcactacaggcagcaccagcgaagaggccgtgacagccgttgccatctgctgccggagccggcacctggcgcaggcctcccaggagctccagtgac

SEQ ID NO: 36 - DNA, 2080 bp, Homo sapiens
atgggcaccgtcagctccaggcggtcctggtggccgctgccactgctgctgctgctgctgctgctcctgggtcccgcgggcgcccgtgcgcaggaggacgaggacggcgactacgaggagctggtgctagccttgctttccgaggaggacggcctggccgaagcacccgagcacggaaccacagccaccttccaccgctgcgccaaggatccgtggaggttgcctggcacctacgtggtggtgctgaaggaggagacccacctctcgcagtcagagcgcactgcccgccgcctgcaggcccaggctgcccgccggggatacctcaccaagatcctgcatgtcttccatggccttcttcctggcttcctggtgaagatgagtggcgacctgctggagctggccttgaagttgccccatgtcgactacatcgaggaggactcctctgtctttgcccagagcatcccgtggaacctggagcggattacccctccacggtaccgggcggatgaataccagccccccgacggaggcagcctggtggaggtgtatctcctagacaccagcatacagagtgaccaccgggaaatcgagggcagggtcatggtcaccgacttcgagaatgtgcccgaggaggacgggacccgcttccacagacaggccagcaagtgtgacagtcatggcacccacctggcaggggtggtcagcggccgggatgccggcgtggccaagggtgccagcatgcgcagcctgcgcgtgctcaactgccaagggaagggcacggttagcggcaccctcataggcctggagtttattcggaaaagccagctggtccagcctgtggggccactggtggtgctgctgcccctggcgggtgggtacagccgcgtcctcaacgccgcctgccagcgcctggcgagggctggggtcgtgctggtcaccgctgccggcaacttccgggacgatgcctgcctctactccccagcctcagctcccgaggtcatcacagttggggccaccaatgcccaagaccagccggtgaccctggggactttggggaccaactttggccgctgtgtggacctctttgccccaggggaggacatcattggtgcctccagcgactgcagcacctgctttgtgtcacagagtgggacatcacaggctgctgcccacgtggctggcattgcagccatgatgctgtctgccgagccggagctcaccctggccgagttgaggcagagactgatccacttctctgccaaagatgtcatcaatgaggcctggttccctgaggaccagcgggtactgacccccaacctggtggccgccctgccccccagcacccatggggcaggttggcagctgttttgcaggactgtatggtcagcacactcggggcctacacggatggccacagccgtcgcccgctgcgccccagatgaggagctgctgagctgctccagtttctccaggagtgggaagcggcggggcgagcgcatggaggcccaagggggcaagctggtctgccgggcccacaacgcttttgggggtgagggtgtctacgccattgccaggtgctgcctgctaccccaggccaactgcagcgtccacacagctccaccagctgaggccagcatggggacccgtgtccactgccaccaacagggccacgtcctcacaggctgcagctcccactgggaggtggaggaccttggcacccacaagccgcctgtgctgaggccacgaggtcagcccaaccagtgcgtgggccacagggaggccagcatccacgcttcctgctgccatgccccaggtctggaatgcaaagtcaaggagcatggaatcccggcccctcaggagcaggtgaccgtggcctgcgaggagggctggaccctgactggctgcagtgccctccctgggacctcccacgtcctgggggcctacgccgtagacaacacgtgtgtagtcaggagccgggacgtcagcactacaggcagcaccagcgaagaggccgtgacagccgttgccatctgctgccggagccggcacctggcgcaggcctcccaggagctccagtgac

SEQ ID NO: 37 - DNA, 2080 bp, Homo sapiens
atgggcaccgtcagctccaggcggtcctggtggccgctgccactgctgctgctgctgctgctgctcctgggtcccgcgggcgcccgtgcgcaggaggacgaggacggcgactacgaggagctggtgctagccttgcgttccgaggaggacggcctggtcgaagcacccgagcacggaaccacagccaccttccaccgctgcgccaaggatccgtggaggttgcctggcacctacgtggtggtgctgaaggaggagacccacctctcgcagtcagagcgcactgcccgccgcctgcaggcccaggctgcccgccggggatacctcaccaagatcctgcatgtcttccatggccttcttcctggcttcctggtgaagatgagtggcgacctgctggagctggccttgaagttgccccatgtcgactacatcgaggaggactcctctgtctttgcccagagcatcccgtggaacctggagcggattacccctccacggtaccgggcggatgaataccagccccccgacggaggcagcctggtggaggtgtatctcctagacaccagcatacagagtgaccaccgggaaatcgagggcagggtcatggtcaccgacttcgagaatgtgcccgaggaggacgggacccgcttccacagacaggccagcaagtgtgacagtcatggcacccacctggcaggggtggtcagcggccgggatgccggcgtggccaagggtgccagcatgcgcagcctgcgcgtgctcaactgccaagggaagggcacggttagcggcaccctcataggcctggagtttattcggaaaagccagctggtccagcctgtggggccactggtggtgctgctgcccctggcgggtgggtacagccgcgtcctcaacgccgcctgccagcgcctggcgagggctggggtcgtgctggtcaccgctgccggcaacttccgggacgatgcctgcctctactccccagcctcagctcccgaggtcatcacagttggggccaccaatgcccaagaccagccggtgaccctggggactttggggaccaactttggccgctgtgtggacctctttgccccaggggaggacatcattggtgcctccagcgactgcagcacctgctttgtgtcacagagtgggacatcacaggctgctgcccacgtggctggcattgcagccatgatgctgtctgccgagccggagctcaccctggccgagttgaggcagagactgatccacttctctgccaaagatgtcatcaatgaggcctggttccctgaggaccagcgggtactgacccccaacctggtggccgccctgccccccagcacccatggggcaggttggcagctgttttgcaggactgtatggtcagcacactcggggcctacacggatggccacagccatcgcccgctgcgccccagatgaggagctgctgagctgctccagtttctccaggagtgggaagcggcggggcgagcgcatggaggcccaagggggcaagctggtctgccgggcccacaacgcttttgggggtgagggtgtctacgccattgccaggtgctgcctgctaccccaggccaactgcagcgtccacacagctccaccagctgaggccagcatggggacccgtgtccactgccaccaacagggccacgtcctcacaggctgcagctcccactgggaggtggaggaccttggcacccacaagccgcctgtgctgaggccacgaggtcagcccaaccagtgcgtgggccacagggaggccagcatccacgcttcctgctgccatgccccaggtctggaatgcaaagtcaaggagcatggaatcccggcccctcaggagcaggtgaccgtggcctgcgaggagggctggaccctgactggctgcagtgccctccctgggacctcccacgtcctgggggcctacgccgtagacaacacgtgtgtagtcaggagccgggacgtcagcactacaggcagcaccagcgaaggggccgtgacagccgttgccatctgctgccggagccggcacctggcgcaggcctcccaggagctccagtgac

SEQ ID NO: 38 - protein, 98 aa, Homo sapiens
EVQLVESGGGLVQPGGSLRLSCAASGFTFSSYAMSWVRQAPGKGLEWVSAISGSGGSTYYADSVKGRFTISRDNSKNTLYLQMNSLRAEDTAVYYCAK

SEQ ID NO: 39 - DNA, 296 bp, Homo sapiens
  CDS (1)..(294)
gaggtgcagctggtggagtctgggggaggcttggtacagcctggggggtccctgagactctcctgtgcagcctctggattcacctttagcagctatgccatgagctgggtccgccaggctccagggaaggggctggagtgggtctcagctattagtggtagtggtggtagcacatactacgcagactccgtgaagggccggttcaccatctccagagacaattccaagaacacgctgtatctgcaaatgaacagcctgagagccgaggacacggccgtatattactgtgcgaaaga

SEQ ID NO: 40 - protein, 25 aa, Homo sapiens [sequence omitted]

SEQ ID NO: 41 - DNA, 990 bp, Homo sapiens
gcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgggtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 42 - protein, 330 aa, Homo sapiens [sequence omitted]

SEQ ID NO: 43 - DNA, 978 bp, Homo sapiens
gcctccaccaagggcccatcggtcttccccctggcgccctgctccaggagcacctccgagagcacagccgccctgggctgcctggtcaaggactacttccccgaaccggtgacggtgtcgtggaactcaggcgctctgaccagcggcgtgcacaccttcccagctgtcctacagtcctcaggactctactccctcagcagcgtggtgaccgtgccctccagcaacttcggcacccagacctacacctgcaacgtagatcacaagcccagcaacaccaaggtggacaagacagttgagcgcaaatgttgtgtcgagtgcccaccgtgcccagcaccacctgtggcaggaccgtcagtcttcctcttccccccaaaacccaaggacaccctcatgatctcccggacccctgaggtcacgtgcgtggtggtggacgtgagccacgaagaccccgaggtccagttcaactggtacgtggacggcgtggaggtgcataatgccaagacaaagccacgggaggagcagttcaacagcacgttccgtgtggtcagcgtcctcaccgttgtgcaccaggactggctgaacggcaaggagtacaagtgcaaggtctccaacaaaggcctcccagcccccatcgagaaaaccatctccaaaaccaaagggcagccccgagaaccacaggtgtacaccctgcccccatcccgggaggagatgaccaagaaccaggtcagcctgacctgcctggtcaaaggcttctaccccagcgacatcgccgtggagtgggagagcaatgggcagccggagaacaactacaagaccacacctcccatgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 44 - protein, 326 aa, Homo sapiens
ASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 45 - DNA, 296 bp, Homo sapiens
caggttcagctggtgcagtctggagctgaggtgaagaagcctggggcctcagtgaaggtctcctgcaaggcttctggttacacctttaccagctatggtatcagctgggtgcgacaggcccctggacaagggcttgagtggatgggatggatcagcgcttacaatggtaacacaaactatgcacagaagctccagggcagagtcaccatgaccacagacacatccacgagcacagcctacatggagctgaggagcctgagatctgacgacacggccgtgtattactgtgcgagaga

SEQ ID NO: 46 - protein, 98 aa, Homo sapiens
QVQLVQSGAEVKKPGASVKVSCKASGYTFTSYGISWVRQAPGQGLEWMGWISAYNGNTNYAQKLQGRVTMTTDTSTSTAYMELRSLRSDDTAVYYCAR

SEQ ID NO: 47 - DNA, 296 bp, Homo sapiens
caggtgcagctggtgcagtctggggctgaggtgaagaagcctggggcctcagtgaaggtttcctgcaaggcatctggatacaccttcaccagctactatatgcactgggtgcgacaggcccctggacaagggcttgagtggatgggaataatcaaccctagtggtggtagcacaagctacgcacagaagttccagggcagagtcaccatgaccagggacacgtccacgagcacagtctacatggagctgagcagcctgagatctgaggacacggccgtgtattactgtgcgagaga

SEQ ID NO: 48 - protein, 98 aa, Homo sapiens
QVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCAR

SEQ ID NO: 49 - DNA, 321 bp, Homo sapiens
cgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 50 - protein, 107 aa, Homo sapiens [sequence omitted]

SEQ ID NO: 51 - DNA, 318 bp, Homo sapiens
ggtcagcccaaggctgccccctcggtcactctgttcccgccctcctctgaggagcttcaagccaacaaggccacactggtgtgtctcataagtgacttctacccgggagccgtgacagtggcttggaaagcagatagcagccccgtcaaggcgggagtggagaccaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttca

SEQ ID NO: 52 - protein, 106 aa, Homo sapiens
GQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 53 - DNA, 365 bp, Homo sapiens
atggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacagctccaacaataagaactacttagcttggtaccagcagaaaccaggacagcctcctaagctgctcatttactgggcatctacccgggaatccggggtccctgaccgattcagtggcagcgggtctgggacagatttcactctcaccatcagcagcctgcaggctgaagatgtggcagtttattactgtcagcaatattatagtactcctcc

SEQ ID NO: 54 - protein, 101 aa, Homo sapiens
DIVMTQSPDSLAVSLGERATINCKSSQSVLYSSNNKNYLAWYQQKPGQPPKLLIYWASTRESGVPDRFSGSGSGTDFTLTISSLQAEDVAVYYCQQYYSTP

SEQ ID NO: 55 - DNA, 654 bp, Homo sapiens
atggacatgagggtccccgctcagctcctggggcttctgctgctctggctcccagcaggtgccagatgtgccatccagttgacccagtctccatcctccctgtctgcatctgtaggagacagagtcaccatcacttgccgggcaagtcagggcattagcagtgctttagcctggtatcagcagaaaccagggaaagctcctaagctcctgatctatgatgcctccagtttggaaagtggggtcccatcaaggttcagcggcagtggatctgggacagatttcactctcaccatcagcagcctgcagcctgaagattttgcaacttattactgtcaacagtttaatagttaccctcagtgccagatgtgccatccagttgacccagtctccatcctccctgtctgcatctgtaggagacagagtcaccatcacttgccgggcaagtcagggcattagcagtgctttagcctggtatcagcagaaaccagggaaagctcctaagctcctgatctatgatgcctccagtttggaaagtggggtcccatcaaggttcagcggcagtggatctgggacagatttcactctcaccatcagcagcctgcagcctgaagattttgcaacttattactgtcaacagtttaatagttaccctca

SEQ ID NO: 56 - skipped

SEQ ID NO: 57 - DNA, 39 bp, Homo sapiens
tgtacacttttggccaggggaccaagctggagatcaaac

SEQ ID NO: 58 - protein, 12 aa, Homo sapiens
YTFGQGTKLEIK

SEQ ID NO: 59 - DNA, 38 bp, Homo sapiens
tgtggtattcggcggagggaccaagctgaccgtcctag

SEQ ID NO: 60 - protein, 12 aa, Homo sapiens
VVFGGGTKLTVL

SEQ ID NO: 61 - protein, 329 aa, Homo sapiens
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 62 - protein, 107 aa, Homo sapiens [sequence omitted]

SEQ ID NO: 63 - protein, 326 aa, Homo sapiens; identical to SEQ ID NO: 44

SEQ ID NO: 64 - protein, 105 aa, Homo sapiens
QPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 65 - protein, 326 aa, Homo sapiens
ASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPSSIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 66 - protein, 107 aa, Homo sapiens [sequence omitted]

SEQ ID NO: 67 - protein, 825 aa, Homo sapiens
MGWLCSGLLFPVSCLVLLQVASSGNMKVLQEPTCVSDYMSISTCEWKMNGPTNCSTELRLLYQLVFLLSEAHTCIPENNGGAGCVCHLLMDDVVSADNYTLDLWAGQQLLWKGSFKPSEHVKPRAPGNLTVHTNVSDTLLLTWSNPYPPDNYLYNHLTYAVNIWSENDPADFRIYNVTYLEPSLRIAASTLKSGISYRARVRAWAQCYNTTWSEWSPSTKWHNSYREPFEQHLLLGVSVSCIVILAVCLLCYVSITKIKKEWWDQIPNPARSRLVAIIIQDAQGSQWEKRSRGQEPAKCPHWKNCLTKLLPCFLEHNMKRDEDPHKAAKEMPFQGSGKSAWCPVEISKTVLWPESISVVRCVELFEAPVECEEEEEVEEEKGSFCASPESSRDDFQEGREGIVARLTESLFLDLLGEENGGFCQQDMGESCLLPPSGSTSAHMPWDEFPSAGPKEAPPWGKEQPLHLEPSPPASPTQSPDNLTCTETPLVIAGNPAYRSFSNSLSQSPCPRELGPDPLLARHLEEVEPEMPCVPQLSEPTTVPQPEPETWEQILRRNVLQHGAAAAPVSAPTSGYQEFVHAVEQGGTQASAVVGLGPPGEAGYKAFSSLLASSAVSPEKCGFGASSGEEGYKPFQDLIPGCPGDPAPVPVPLFTFGLDREPPRSPQSSHLPSSSPEHLGLEPGEKVEDMPKPPLPQEQATDPLVDSLGSGIVYSALTCHLCGHLKQCHGQEDGGQTPVMASPCCGCCCGDRSSPPTTPLRAPDPSPGGVPLEASLCPASLAPSGISEKSKSSSSFHPAPGNAQSSSQTPKIVNFVSVGPTYMRVS

SEQ ID NO: 68 - DNA, 2478 bp, Homo sapiens
atggggtggctttgctctgggctcctgttccctgtgagctgcctggtcctgctgcaggtggcaagctctgggaacatgaaggtcttgcaggagcccacctgcgtctccgactacatgagcatctctacttgcgagtggaagatgaatggtcccaccaattgcagcaccgagctccgcctgttgtaccagctggtttttctgctctccgaagcccacacgtgtatccctgagaacaacggaggcgcggggtgcgtgtgccacctgctcatggatgacgtggtcagtgcggataactatacactggacctgtgggctgggcagcagctgctgtggaagggctccttcaagcccagcgagcatgtgaaacccagggccccaggaaacctgacagttcacaccaatgtctccgacactctgctgctgacctggagcaacccgtatccccctgacaattacctgtataatcatctcacctatgcagtcaacatttggagtgaaaacgacccggcagatttcagaatctataacgtgacctacctagaaccctccctccgcatcgcagccagcaccctgaagtctgggatttcctacagggcacgggtgagggcctgggctcagtgctataacaccacctggagtgagtggagccccagcaccaagtggcacaactcctacagggagcccttcgagcagcacctcctgctgggcgtcagcgtttcctgcattgtcatcctggccgtctgcctgttgtgctatgtcagcatcaccaagattaagaaagaatggtgggatcagattcccaacccagcccgcagccgcctcgtggctataataatccaggatgctcaggggtcacagtgggagaagcggtcccgaggccaggaaccagccaagtgcccacactggaagaattgtcttaccaagctcttgccctgttttctggagcacaacatgaaaagggatgaagatcctcacaaggctgccaaagagatgcctttccagggctctggaaaatcagcatggtgcccagtggagatcagcaagacagtcctctggccagagagcatcagcgtggtgcgatgtgtggagttgtttgaggccccggtggagtgtgaggaggaggaggaggtagaggaagaaaaagggagcttctgtgcatcgcctgagagcagcagggatgacttccaggagggaagggagggcattgtggcccggctaacagagagcctgttcctggacctgctcggagaggagaatgggggcttttgccagcaggacatgggggagtcatgccttcttccaccttcgggaagtacgagtgctcacatgccctgggatgagttcccaagtgcagggcccaaggaggcacctccctggggcaaggagcagcctctccacctggagccaagtcctcctgccagcccgacccagagtccagacaacctgacttgcacagagacgcccctcgtcatcgcaggcaaccctgcttaccgcagcttcagcaactccctgagccagtcaccgtgtcccagagagctgggtccagacccactgctggccagacacctggaggaagtagaacccgagatgccctgtgtcccccagctctctgagccaaccactgtgccccaacctgagccagaaacctgggagcagatcctccgccgaaatgtcctccagcatggggcagctgcagcccccgtctcggcccccaccagtggctatcaggagtttgtacatgcggtggagcagggtggcacccaggccagtgcggtggtgggcttgggtcccccaggagaggctggttacaaggccttctcaagcctgcttgccagcagtgctgtgtccccagagaaatgtgggtttggggctagcagtggggaagaggggtataagcctttccaagacctcattcctggctgccctggggaccctgccccagtccctgtccccttgttcacctttggactggacagggagccacctcgcagtccgcagagctcacatctcccaagcagctccccagagcacctgggtctggagccgggggaaaaggtagaggacatgccaaagcccccacttccccaggagcaggccacagacccccttgtggacagcctgggcagtggcattgtctactcagcccttacctgccacctgtgcggccacctgaaacagtgtcatggccaggaggatggtggccagacccctgtcatggccagtccttgctgtggctgctgctgtggagacaggtcctcgccccctacaacccccctgagggccccagacccctctccaggtggggttccactggaggccagtctgtgtccggcctccctggcaccctcgggcatctcagagaagagtaaatcctcatcatccttccatcctgcccctggcaatgctcagagctcaagccagacccccaaaatcgtgaactttgtctccgtgggacccacatacatgagggtctcttag

SEQ ID NO: 69 - protein, 125 aa, Homo sapiens [sequence omitted]

SEQ ID NO: 70 - protein, 112 aa, Homo sapiens [sequence omitted]

SEQ ID NO: 71 - protein, 451 aa, Homo sapiens
EVQLVESGGGLEQPGGSLRLSCAGSGFTFRDYAMTWVRQAPGKGLEWVSSISGSGGNTYYADSVKGRFTISRDNSKNTLYLQMNSLRAEDTAVYYCAKDRLSITIRPRYYGLDVWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG

SEQ ID NO: 72 - protein, 214 aa, Homo sapiens
DIVMTQSPLSLPVTPGEPASISCRSSQSLLYSIGYNYLDWYLQKSGQSPQLLIYLGSNRASGVPDRFSGSGSGTDFTLKISRVEAEDVGFYYCMQALQTPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSF

SEQ ID NO: 73 - protein, 327 aa, Homo sapiens
ASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 74 - DNA, 984 bp, Homo sapiens
gcttccaccaagggcccatcggtcttccccctggcgccctgctccaggagcacctccgagagcacagccgccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaagacctacacctgcaacgtagatcacaagcccagcaacaccaaggtggacaagagagttgagtccaaatatggtcccccatgcccatcatgcccagcacctgagttcctggggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctcaccgtggacaagagcaggtggcaggaggggaatgtcttctcatgctccgtgatgcatgaggctctgcacaaccactacacacagaagagcctctccctgtctctgggtaaatga

SEQ ID NO: 75 - protein, 1988 aa, Homo sapiens
MAMLPPPGPQSFVHFTKQSLALIEQRIAERKSKEPKEEKKDDDEEAPKPSSDLEAGKQLPFIYGDIPPGMVSEPLEDLDPYYADKKTFIVLNKGKTIFRFNATPALYMLSPFSPLRRISIKILVHSLFSMLIMCTILTNCIFMTMNNPPDWTKNVEYTFTGIYTFESLVKILARGFCVGEFTFLRDPWNWLDFVVIVFAYLTEFVNLGNVSALRTFRVLRALKTISVIPGLKTIVGALIQSVKKLSDVMILTVFCLSVFALIGLQLFMGNLKHKCFRNSLENNETLESIMNTLESEEDFRKYFYYLEGSKDALLCGFSTDSGQCPEGYTCVKIGRNPDYGYTSFDTFSWAFLALFRLMTQDYWENLYQQTLRAAGKTYMIFFVVVIFLGSFYLINLILAVVAMAYEEQNQANIEEAKQKELEFQQMLDRLKKEQEEAEAIAAAAAEYTSIRRSRIMGLSESSSETSKLSSKSAKERRNRRKKKNQKKLSSGEEKGDAEKLSKSESEDSIRRKSFHLGVEGHRRAHEKRLSTPNQSPLSIRGSLFSARRSSRTSLFSFKGRGRDIGSETEFADDEHSIFGDNESRRGSLFVPHRPQERRSSNISQASRSPPMLPVNGKMHSAVDCNGVVSLVDGRSALMLPNGQLLPEVIIDKATSDDSGTTNQIHKKRRCSSYLLSEDMLNDPNLRQRAMSRASILTNTVEELEESRQKCPPWWYRFAHKFLIWNCSPYWIKFKKCIYFIVMDPFVDLAITICIVLNTLFMAMEHHPMTEEFKNVLAIGNLVFTGIFAAEMVLKLIAMDPYEYFQVGWNIFDSLIVTLSLVELFLADVEGLSVLRSFRLLRVFKLAKSWPTLNMLIKIIGNSVGALGNLTLVLAIIVFIFAVVGMQLFGKSYKECVCKINDDCTLPRWHMNDFFHSFLIVFRVLCGEWIETMWDCMEVAGQAMCLIVYMMVMVIGNLVVLNLFLALLLSSFSSDNLTAIEEDPDANNLQIAVTRIKKGINYVKQTLREFILKAFSKKPKISREIRQAEDLNTKKENYISNHTLAEMSKGHNFLKEKDKISGFGSSVDKHLMEDSDGQSFIHNPSLTVTVPIAPGESDLENMNAEELSSDSDSEYSKVRLNRSSSSECSTVDNPLPGEGEEAEAEPMNSDEPEACFTDGCVWRFSCCQVNIESGKGKIWWNIRKTCYKIVEHSWFESFIVLMILLSSGALAFEDIYIERKKTIKIILEYADKIFTYIFILEMLLKWIAYGYKTYFTNAWCWLDFLIVDVSLVTLVANTLGYSDLGPIKSLRTLRALRPLRALSRFEGMRVVVNALIGAIPSIMNVLLVCLIFWLIFSIMGVNLFAGKFYECINTTDGSRFPASQVPNRSECFALMNVSQNVRWKNLKVNFDNVGLGYLSLLQVATFKGWTIIMYAAVDSVNVDKQPKYEYSLYMYIYFVVFIIFGSFFTLNLFIGVIIDNFNQQKKKLGGQDIFMTEEQKKYYNAMKKLGSKKPQKPIPRPGNKIQGCIFDLVTNQAFDISIMVLICLNMVTMMVEKEGQSQHMTEVLYWINVVFIILFTGECVLKLISLRHYYFTVGWNIFDFVVVIISIVGMFLADLIETYFVSPTLFRVIRLARIGRILRLVKGAKGIRTLLFALMMSLPALFNIGLLLFLVMFIYAIFGMSNFAYVKKEDGINDMFNFETFGNSMICLFQITTSAGWDGLLAPILNSKPPDCDPKKVHPGSSVEGDCGNPSVGIFYFVSYIIISFLVVVNMYIAVILENFSVATEESTEPLSEDDFEMFYEVWEKFDPDATQFIEFSKLSDFAAALDPPLLIAKPNKVQLIAMDLPMVSGDRIHCLDILFAFTKRVLGESGEMDSLRSQMEERFMSANPSKVSYEPITTTLKRKQEDVSATVIQRAYRRYRLRQNVKNISSIYIKDGDRDDDLLNKKDMAFDNVNENSSPEKTDATSSTTSPPSYDSVTKPDKEKYEQDRTEKEDKGKDSKESKK

SEQ ID NO: 76 - DNA, 5965 bp, Homo sapiens
atggcaatgttgcctcccccaggacctcagagctttgtccatttcacaaaacagtctcttgccctcattgaacaacgcattgctgaaagaaaatcaaaggaacccaaagaagaaaagaaagatgatgatgaagaagccccaaagccaagcagtgacttggaagctggcaaacagctgcccttcatctatggggacattcctcccggcatggtgtcagagcccctggaggacttggacccctactatgcagacaaaaagactttcatagtattgaacaaagggaaaacaatcttccgtttcaatgccacacctgctttatatatgctttctcctttcagtcctctaagaagaatatctattaagattttagtacactccttattcagcatgctcatcatgtgcactattctgacaaactgcatatttatgaccatgaataacccaccggactggaccaaaaatgtcgagtacacttttactggaatatatacttttgaatcacttgtaaaaatccttgcaagaggcttctgtgtaggagaattcacttttcttcgtgacccgtggaactggctggattttgtcgtcattgtttttgcgtatttaacagaatttgtaaacctaggcaatgtttcagctcttcgaactttcagagtattgagagctttgaaaactatttctgtaatcccaggcctgaagacaattgtaggggctttgatccagtcagtgaagaagctttctgatgtcatgatcctgactgtgttctgtctgagtgtgtttgcactaattggactacagctgttcatgggaaacctgaagcataaatgttttcgaaattcacttgaaaataatgaaacattagaaagcataatgaataccctagagagtgaagaagactttagaaaatatttttattacttggaaggatccaaagatgctctcctttgtggtttcagcacagattcaggtcagtgtccagaggggtacacctgtgtgaaaattggcagaaaccctgattatggctacacgagctttgacactttcagctgggccttcttagccttgtttaggctaatgacccaagattactgggaaaacctttaccaacagacgctgcgtgctgctggcaaaacctacatgatcttctttgtcgtagtgattttcctgggctccttttatctaataaacttgatcctggctgtggttgccatggcatatgaagaacagaaccaggcaaacattgaagaagctaaacagaaagaattagaatttcaacagatgttagaccgtcttaaaaaagagcaagaagaagctgaggcaattgcagcggcagcggctgaatatacaagtattaggagaagcagaattatgggcctctcagagagttcttctgaaacatccaaactgagctctaaaagtgctaaagaaagaagaacagaagaaagaaaaagaatcaaaagaagctctccagtggagaggaaaagggagatgctgagaaattgtcgaaatcagaatcagaggacagcatcagaagaaaaagtttccaccttggtgtcgaagggcataggcgagcacatgaaaagaggttgtctacccccaatcagtcaccactcagcattcgtggctccttgttttctgcaaggcgaagcagcagaacaagtctttttagtttcaaaggcagaggaagagatataggatctgagactgaatttgccgatgatgagcacagcatttttggagacaatgagagcagaaggggctcactgtttgtgccccacagaccccaggagcgacgcagcagtaacatcagccaagccagtaggtccccaccaatgctgccggtgaacgggaaaatgcacagtgctgtggactgcaacggtgtggtctccctggttgatggacgctcagccctcatgctccccaatggacagcttctgccagaggtgataatagataaggcaacttctgatgacagcggcacgaccaatcaaatacacaagaaaaggcgttgtagttcctatctcctttcagaggatatgctgaatgatcccaacctcagacagagagcaatgagtagagcaagcatattaacaaacactgtggaagaacttgaagagtccagacaaaaatgtccaccttggtggtacagatttgcacacaaattcttgatctggaattgctctccatattggataaaattcaaaaagtgtatctattttattgtaatggatccttttgtagatcttgcaattaccatttgcatagttttaaacacattatttatggctatggaacaccacccaatgactgaggaattcaaaaatgtactgctataggaaatttggtctttactggaatctttgcagctgaaatggtattaaaactgattgccatggatccatatgagtatttccaagtaggctggaatatttttgacagccttattgtgactttaagtttagtggagctctttctagcagatgtggaaggattgtcagttctgcgatcattcagactgctccgagtcttcaagttggcaaaatcctggccaacattgaacatgctgattaagatcattggtaactcagtaggggctctaggtaacctcaccttagtgttggccatcatcgtcttcatttttgctgtggtcggcatgcagctctttggtaagagctacaaagaatgtgtctgcaagatcaatgatgactgtacgctcccacggtggcacatgaacgacttcttccactccttcctgattgtgttccgcgtgctgtgtggagagtggatagagaccatgtgggactgtatggaggtcgctggtcaagctatgtgccttattgtttacatgatggtcatggtcattggaaacctggtggtcctaaacctatttctggccttattattgagctcatttagttcagacaatcttacagcaattgaagaagaccctgatgcaaacaacctccagattgcagtgactagaattaaaaagggaataaattatgtgaaacaaaccttacgtgaatttattctaaaagcattttccaaaaagccaaagatttccagggagataagacaagcagaagatctgaatactaagaaggaaaactatatttctaaccatacacttgctgaaatgagcaaaggtcacaatttcctcaaggaaaaagataaaatcagtggttttggaagcagcgtggacaaacacttgatggaagacagtgatggtcaatcatttattcacaatcccagcctcacagtgacagtgccaattgcacctggggaatccgatttggaaaatatgaatgctgaggaacttagcagtgattcggatagtgaatacagcaaagtgagattaaaccggtcaagctcctcagagtgcagcacagttgataaccctttgcctggagaaggagaagaagcagaggctgaacctatgaattccgatgagccagaggcctgtttcacagatggttgtgtatggaggttctcatgctgccaagttaacatagagtcagggaaaggaaaaatctggtggaacatcaggaaaacctgctacaagattgttgaacacagttggtttgaaagcttcattgtcctcatgatcctgctcagcagtggtgccctggcttttgaagatatttatattgaaaggaaaaagaccattaagattatcctggagtatgcagacaagatcttcacttacatcttcattctggaaatgcttctaaaatggatagcatatggttataaaacatatttcaccaatgcctggtgttggctggatttcctaattgttgatgtttctttggttactttagtggcaaacactcttggctactcagatcttggccccattaaatcccttcggacactgagagctttaagacctctaagagccttatctagatttgaaggaatgagggtcgttgtgaatgcactcataggagcaattccttccatcatgaatgtgctacttgtgtgtcttatattctggctgatattcagcatcatgggagtaaatttgtttgctggcaagttctatgagtgtattaacaccacagatgggtcacggtttcctgcaagtcaagttccaaatcgttccgaatgttttgcccttatgaatgttagtcaaaatgtgcgatggaaaaacctgaaagtgaactttgataatgtcggacttggttacctatctctgcttcaagttgcaacttttaagggatggacgattattatgtatgcagcagtggattctgttaatgtagacaagcagcccaaatatgaatatagcctctacatgtatatttattttgtcgtctttatcatctttgggtcattcttcactttgaacttgttcattggtgtcatcatagataatttcaaccaacagaaaaagaagcttggaggtcaagacatctttatgacagaagaacagaagaaatactataatgcaatgaaaaagctggggtccaagaagccacaaaagccaattcctcgaccagggaacaaaatccaaggatgtatatttgacctagtgacaaatcaagcctttgatattagtatcatggttcttatctgtctcaacatggtaaccatgatggtagaaaaggagggtcaaagtcaacatatgactgaagttttatattggataaatgtggtttttataatccttttcactggagaatgtgtgctaaaactgatctccctcagacactactacttcactgtaggatggaatatttttgattttgtggttgtgattatctccattgtaggtatgtttctagctgatttgattgaaacgtattttgtgtcccctaccctgttccgagtgatccgtcttgccaggattggccgaatcctacgtctagtcaaaggagcaaaggggatccgcacgctgctctttgctttgatgatgtcccttcctgcgttgtttaacatcggcctcctgctcttcctggtcatgttcatctacgccatctttggaatgtccaactttgcctatgttaaaaaggaagatggaattaatgacatgttcaattttgagacctttggcaacagtatgatttgcctgttccaaattacaacctctgctggctgggatggattgctagcacctattcttaacagtaagccacccgactgtgacccaaaaaaagttcatcctggaagttcagttgaaggagactgtggtaacccatctgttggaatattctactttgttagttatatcatcatatccttcctggttgtggtgaacatgtacattgcagtcatactggagaattttagtgttgccactgaagaaagtactgaacctctgagtgaggatgactttgagatgttctatgaggtttgggagaagtttgatcccgatgcgacccagtttatagagttctctaaactctctgattttgcagctgccctggatcctcctcttctcatagcaaaacccaacaaagtccagctcattgccatggatctgcccatggttagtggtgaccggatccattgtcttgacatcttatttgcttttacaaagcgtgttttgggtgagagtggggagatggattctcttcgttcacagatggaagaaaggttcatgtctgcaaatccttccaaagtgtcctatgaacccatcacaaccacactaaaacggaaacaagaggatgtgtctgctactgtcattcagcgtgcttatagacgttaccgcttaaggcaaaatgtcaaaaatatatcaagtatatacataaaagatggagacagagatgatgatttactcaataaaaaagatatggcttttgataatgttaatgagaactcaagtccagaaaaaacagatgccacttcatccaccacctctccaccttcatatgatagtgtaacaaagccagacaaagagaaatatgaacaagacagaacagaaaaggaagacaaagggaaagacagcaaggaaagcaaaaaatag

SEQ ID NO: 77 - skipped

SEQ ID NO: 78 - protein, 468 aa, Homo sapiens
MLAVGCALLAALLAAPGAALAPRRCPAQEVARGVLTSLPGDSVTLTCPGVEPEDNATVHWVLRKPAAGSHPSRWAGMGRRLLLRSVQLHDSGNYSCYRAGRPAGTVHLLVDVPPEEPQLSCFRKSPLSNVVCEWGPRSTPSLTTKAVLLVRKFQNSPAEDFQEPCQYSQESQKFSCQLAVPEGDSSFYIVSMCVASSVGSKFSKTQTFQGCGILQPDPPANITVTAVARNPRWLSVTWQDPHSWNSSFYRLRFELRYRAERSKTFTTWMVKDLQHHCVIHDAWSGLRHVVQLRAQEEFGQGEWSEWSPEAMGTPWTESRSPPAENEVSTPMQALTTNKDDDNILFRDSANATSLPVQDSSSVPLPTFLVAGGSLAFGTLLCIAIVLRFKKTWKLRALKEGKTSMHPPYSLGQLVPERPRPTPVLVPLISPPVSPSSLGSDNTSSHNRPDARDPRSPYDISNTDYFFPR

SEQ ID NO: 79 - DNA, 1407 bp, Homo sapiens
atgctggccgtcggctgcgcgctgctggctgccctgctggccgcgccgggagcggcgctggccccaaggcgctgccctgcgcaggaggtggcgagaggcgtgctgaccagtctgccaggagacagcgtgactctgacctgcccgggggtagagccggaagacaatgccactgttcactgggtgctcaggaagccggctgcaggctcccaccccagcagatgggctggcatgggaaggaggctgctgctgaggtcggtgcagctccacgactctggaaactattcatgctaccgggccggccgcccagctgggactgtgcacttgctggtggatgttccccccgaggagccccagctctcctgcttccggaagagccccctcagcaatgttgtttgtgagtggggtcctcggagcaccccatccctgacgacaaaggctgtgctcttggtgaggaagtttcagaacagtccggccgaagacttccaggagccgtgccagtattcccaggagtcccagaagttctcctgccagttagcagtcccggagggagacagctctttctacatagtgtccatgtgcgtcgccagtagtgtcgggagcaagttcagcaaaactcaaacctttcagggttgtggaatcttgcagcctgatccgcctgccaacatcacagtcactgccgtggccagaaacccccgctggctcagtgtcacctggcaagacccccactcctggaactcatctttctacagactacggtttgagctcagatatcgggctgaacggtcaaagacattcacaacatggatggtcaaggacctccagcatcactgtgtcatccacgacgcctggagcggcctgaggcacgtggtgcagcttcgtgcccaggaggagttcgggcaaggcgagtggagcgagtggagcccggaggccatgggcacgccttggacagaatccaggagtcctccagctgagaacgaggtgtccacccccatgcaggcacttactactaataaagacgatgataatattctcttcagagattctgcaaatgcgacaagcctcccagtgcaagattcttcttcagtaccactgcccacattcctggttgctggagggagcctggccttcggaacgctcctctgcattgccattgttctgaggttcaagaagacgtggaagctgcgggctctgaaggaaggcaagacaagcatgcatccgccgtactctttggggcagctggtcccggagaggcctcgacccaccccagtgcttgttcctctcatctccccaccggtgtcccccagcagcctggggtctgacaatacctcgagccacaaccgaccagatgccagggacccacggagcccttatgacatcagcaatacagactacttcttccccagatag

SEQ ID NO: 80 - DNA, 990 bp, Homo sapiens; identical to SEQ ID NO: 41

SEQ ID NO: 81 - protein, 330 aa, Homo sapiens [sequence omitted]

SEQ ID NO: 82 - DNA, 978 bp, Homo sapiens; identical to SEQ ID NO: 43

SEQ ID NO: 83 - protein, 326 aa, Homo sapiens; identical to SEQ ID NO: 44

SEQ ID NO: 84 - DNA, 298 bp, Homo sapiens
gaagtgcagctggtggagtctgggggaggcttggtacagcctggcaggtccctgagactctcctgtgcagcctctggattcacctttgatgattatgccatgcactgggtccggcaagctccagggaagggcctggagtgggtctcaggtattagttggaatagtggtagcataggctatgcggactctgtgaagggccgattcaccatctccagagacaacgccaagaactccctgtatctgcaaatgaacagtctgagagctgaggacacggccttgtattactgtgcaaaagata

SEQ ID NO: 85 - protein, 99 aa, Homo sapiens
EVQLVESGGGLVQPGRSLRLSCAASGFTFDDYAMHWVRQAPGKGLEWVSGISWNSGSIGYADSVKGRFTISRDNAKNSLYLQMNSLRAEDTALYYCAKD

SEQ ID NO: 86 - DNA, 296 bp, Homo sapiens
gaggtgcagctggtggagtctgggggaggcttggtccagcctggggggtccctgagactctcctgtgcagcctctggattcacctttagtagctattggatgagctgggtccgccaggctccagggaaggggctggagtgggtggccaacataaagcaagatggaagtgagaaatactatgtggactctgtgaagggccgattcaccatctccagagacaacgccaagaactcactgtatctgcaaatgaacagcctgagagccgaggacacggctgtgtattactgtgcgagaga

SEQ ID NO: 87 - protein, 98 aa, Homo sapiens
EVQLVESGGGLVQPGGSLRLSCAASGFTFSSYWMSWVRQAPGKGLEWVANIKQDGSEKYYVDSVKGRFTISRDNAKNSLYLQMNSLRAEDTAVYYCAR

SEQ ID NO: 88 - DNA, 50 bp, Homo sapiens
tgatgcttttgatatctggggccaagggacaatggtcaccgtctcttcag

SEQ ID NO: 89 - protein, 16 aa, Homo sapiens
DAFDIWGQGTMVTVSS

SEQ ID NO: 90 - DNA, 63 bp, Homo sapiens
attactactactactacggtatggacgtctgggggcaagggaccacggtcaccgtctcctcag

SEQ ID NO: 91 - protein, 20 aa, Homo sapiens
YYYYYGMDVWGQGTTVTVSS

SEQ ID NO: 92 - DNA, 321 bp, Homo sapiens; identical to SEQ ID NO: 49

SEQ ID NO: 93 - protein, 107 aa, Homo sapiens [sequence omitted]

SEQ ID NO: 94 - DNA, 312 bp, Homo sapiens
cccaaggccaaccccacggtcactctgttcccgccctcctctgaggagctccaagccaacaaggccacactagtgtgtctgatcagtgacttctacccgggagctgtgacagtggcttggaaggcagatggcagccccgtcaaggcgggagtggagacgaccaaaccctccaaacagagcaacaacaagtacgcggccagcagctacctgagcctgacgcccgagcagtggaagtcccacagaagctacagctgccaggtcacgcatgaagggagcaccgtggagaagacagtggcccctacagaatgttca

SEQ ID NO: 95 - protein, 104 aa, Homo sapiens
PKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECS

SEQ ID NO: 96 - DNA, 287 bp, Homo sapiens
gacatccagatgacccagtctccatcttccgtgtctgcatctgtaggagacagagtcaccatcacttgtcgggcgagtcagggtattagcagctggttagcctggtatcagcagaaaccagggaaagcccctaagctcctgatctatgctgcatccagtttgcaaagtggggtcccatcaaggttcagcggcagtggatctgggacagatttcactctcaccatcagcagcctgcagcctgaagattttgcaacttactattgtcaacaggctaacagtttccctcc

SEQ ID NO: 97 - protein, 95 aa, Homo sapiens
DIQMTQSPSSVSASVGDRVTITCRASQGISSWLAWYQQKPGKAPKLLIYAASSLQSGVPSRFSGSGSGTDFTLTISSLQPEDFATYYCQQANSFP

SEQ ID NO: 98 - DNA, 287 bp, Homo sapiens
gaaattgtgttgacacagtctccagccaccctgtctttgtctccaggggaaagagccaccctctcctgcagggccagtcagagtgttagcagctacttagcctggtaccaacagaaacctggccaggctcccaggctcctcatctatgatgcatccaacagggccactggcatcccagccaggttcagtggcagtgggtctgggacagacttcactctcaccatcagcagcctagagcctgaagattttgcagtttattactgtcagcagcgtagcaactggcctcc

SEQ ID NO: 99 - protein, 95 aa, Homo sapiens
EIVLTQSPATLSLSPGERATLSCRASQSVSSYLAWYQQKPGQAPRLLIYDASNRATGIPARFSGSGSGTDFTLTISSLEPEDFAVYYCQQRSNWP

SEQ ID NO: 100 - DNA, 39 bp, Homo sapiens; identical to SEQ ID NO: 57

SEQ ID NO: 101 - protein, 12 aa, Homo sapiens
YTFGQGTKLEIK

SEQ ID NO: 102 - DNA, 38 bp, Homo sapiens
gctcactttcggcggagggaccaaggtggagatcaaac

SEQ ID NO: 103 - protein, 12 aa, Homo sapiens
LTFGGGTKVEIK

SEQ ID NO: 104 - protein, 446 aa, Homo sapiens
EVQLVESGGGLVQPGRSLRLSCAASRFTFDDYAMHWVRQAPGKGLEWVSGISWNSGRIGYADSVKGRFTISRDNAENSLFLQMNGLRAEDTALYYCAKGRDSFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVTYLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 105 - protein, 214 aa, Homo sapiens
DIQMTQSPSSVSASVGDRVTITCRASQGISSWLAWYQQKPGKAPKLLIYGASSLESGVPSRFSGSGSGTDFTLTISSLQPEDFASYYCQQANSFPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 106 - protein, 449 aa, Homo sapiens
EVQLVESGGGLVQPGGSLRLSCAASGFTFSPFAMSWVRQAPGKGLEWVAKISPGGSWTYYSDTVTGRFTISRDNAKNSLYLQMNSLRAEDTAVYYCARQLWGYYALDIWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 107 - protein, 213 aa, Homo sapiens
EIVLTQSPATLSLSPGERATLSCSASISVSYMYWYQQKPGQAPRLLIYDMSNLASGIPARFSGSGSGTDFTLTISSLEPEDFAVYYCMQWSGYPYTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 108 - DNA, 24 bp, Homo sapiens
ggattcacctttgatgattatgcc

SEQ ID NO: 109 - protein, 8 aa, Homo sapiens
GFTFDDYA

SEQ ID NO: 110 - DNA, 114 bp, Homo sapiens
ggctatgcggactctgtgaagggccgattcaccatctccagagacaacgccaagaactccctgtatctgcaaatgaacagtctgagagctgaggacacggccttgtattactgt

SEQ ID NO: 111 - protein, 38 aa, Homo sapiens
GYADSVKGRFTISRDNAKNSLYLQMNSLRAEDTALYYC

SEQ ID NO: 112 - DNA, 23 bp, Homo sapiens
cagcagcgtagcaactggcctcc

SEQ ID NO: 113 - protein, 7 aa, Homo sapiens
QQRSNWP

SEQ ID NO: 114 - DNA, 108 bp, Homo sapiens
aacagggccactggcatcccagccaggttcagtggcagtgggtctgggacagacttcactctcaccatcagcagcctagagcctgaagattttgcagtttattactgt

SEQ ID NO: 115 - protein, 36 aa, Homo sapiens [sequence omitted]

SEQ ID NO: 116 - protein, 7 aa, Artificial Sequence
  Description of Artificial Sequence: Synthetic peptide
VFAQSIP

SEQ ID NO: 117 - DNA, 296 bp, Homo sapiens
  CDS (1)..(294)
gaggtgcagctgttggagtctgggggaggcttggtacagcctggggggtccctgagactctcctgtgcagcctctggattcacctttagcagctatgccatgagctgggtccgccaggctccagggaaggggctggagtgggtctcagctattagtggtagtggtggtagcacatactacgcagactccgtgaagggccggttcaccatctccagagacaattccaagaacacgctgtatctgcaaatgaacagcctgagagccgaggacacggccgtatattactgtgcgaaaga

SEQ ID NO: 118 - protein, 98 aa, Homo sapiens
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAK

SEQ ID NO: 119 - DNA, 294 bp, Homo sapiens
  CDS (1)..(294)
gaggtgcagctgttggagtctgggggaggcttggtacagcctggggggtccctgagactctcctgtgcagcctctggattcacctttagcagctatgccatgagctgggtccgccaggctccagggaaggggctggagtgggtctcagctattagtggtagtggtggtagcacatactacgcagactccgtgaagggccggttcaccatctccagagacaattccaagaacacgctgtatctgcaaatgaacagcctgagagccgaggacacggccgtatattactgtgcgaaa

SEQ ID NO: 120 - DNA, 296 bp, Homo sapiens
  CDS (1)..(294)
gaggtgcagctgttggagtctgggggaggcttggtacagcctggggggtccctgagactctcctgtgcagcctctggattcacctttagcagctatgccatgagctgggtccgccaggctccagggaaggggctggagtgggtctcagctattagtggtagtggtggtagcacatactacggagactccgtgaagggccggttcaccatctcaagagacaattccaagaacacgctgtatctgcaaatgaacagcctgagagccgaggacacggccgtatattactgtgcgaaaga

SEQ ID NO: 121 - protein, 98 aa, Homo sapiens
EVQLLESGGGLVQPGGSLRLSCAASGFTFSSYAMSWVRQAPGKGLEWVSAISGSGGSTYYGDSVKGRFTISRDNSKNTLYLQMNSLRAEDTAVYYCAK

SEQ ID NO: 122 - DNA, 294 bp, Homo sapiens
  CDS (1)..(294)
gaggtgcagctgttggagtctgggggaggcttggtacagcctggggggtccctgagactctcctgtgcagcctctggattcacctttagcagctatgccatgagctgggtccgccaggctccagggaaggggctggagtgggtctcagttatttatagcggtggtagtagcacatactatgcagactccgtgaagggccggttcaccatctccagagataattccaagaacacgctgtatctgcaaatgaacagcctgagagccgaggacacggccgtatattactgtgcgaaa

SEQ ID NO: 123 - protein, 98 aa, Homo sapiens
EVQLLESGGGLVQPGGSLRLSCAASGFTFSSYAMSWVRQAPGKGLEWVSVIYSGGSSTYYADSVKGRFTISRDNSKNTLYLQMNSLRAEDTAVYYCAK

SEQ ID NO: 124 - DNA, 296 bp, Homo sapiens
  CDS (1)..(294)
gaggtgcagctgttggagtctgggggaggcttggtacagcctggggggtccctgagactctcctgtgcagcctctggattcacctttagcagctatgccatgagctgggtccgccaggctccagggaaggggctggagtgggtctcagttatttatagcggtggtagtagcacatactatgcagactccgtgaagggccggttcaccatctccagagataattccaagaacacgctgtatctgcaaatgaacagcctgagagccgaggacacggccgtatattactgtgcgaaaga

SEQ ID NO: 125 - DNA, 294 bp, Homo sapiens
  CDS (1)..(294)
gaggtgcagctgttggagtctgggggaggcttggtacagcctggggggtccctgagactctcctgtgcagcctctggattcacctttagcagctatgccatgagctgggtccgccaggctccagggaaggggctggagtgggtctcagctatttatagcagtggtagtagcacatactatgcagactccgtgaagggccggttcaccatctccagagacaattccaagaacacgctgtatctgcaaatgaacagcctgagagccgaggacacggccgtatattactgtgcgaaa

SEQ ID NO: 126 - protein, 98 aa, Homo sapiens
EVQLLESGGGLVQPGGSLRLSCAASGFTFSSYAMSWVRQAPGKGLEWVSAIYSSGSSTYYADSVKGRFTISRDNSKNTLYLQMNSLRAEDTAVYYCAK

SEQ ID NO: 127 - protein, 431 aa, Artificial Sequence
  Description of Artificial Sequence: Synthetic polypeptide
SDTGRPFVEMYSEIPEIIHMTEGRELVIPCRVTSPNITVTLKKFPLDTLIPDGKRIIWDSRKGFIISNATYKEIGLLTCEATVNGHLYKTNYLTHRQTNTIIDVVLSPSHGIELSVGEKLVLNCTARTELNVGIDFNWEYPSSKHQHKKLVNRDLKTQSGSEMKKFLSTLTIDGVTRSDQGLYTCAASSGLMTKKNSTFVRVHEKDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 128 - protein, 10 aa, Artificial Sequence
  Description of Artificial Sequence: Synthetic peptide
DKTHTCPPCP

SEQ ID NO: 129 - protein, 64 aa, Artificial Sequence
  Description of Artificial Sequence: Synthetic polypeptide
GRELVIPCRVTSPNITVTLKKFPLDTLIPDGKRIIWDSRKGFIISNATYKEIGLLTCEATVNGH

SEQ ID NO: 130 - protein, 97 aa, Artificial Sequence
  Description of Artificial Sequence: Synthetic polypeptide
YDVVLSPSHGIELSVGEKLVLNCTARTELNVGIDFNWEYPSSKHQHKKLVNRDLKTQSGSEMKKFLSTLTIDGVTRSDQGLYTCAASSGLMTKKNST

SEQ ID NO: 131 - protein, 232 aa, Homo sapiens
MNFLLSWVHWSLALLLYLHHAKWSQAAPMAEGGGQNHHEVVKFMDVYQRSYCHPIETLVDIFQEYPDEIEYIFKPSCVPLMRCGGCCNDEGLECVPTEESNITMQIMRIKPHQGQHIGEMSFLQHNKCECRPKKDRARQEKKSVRGKGKGQKRKRKKSRYKSWSVYVGARCCLMPWSLPGPHPCGPCSERRKHLFVQDPQTCKCSCKNTDSRCKARQLELNERTCRCDKPRR

SEQ ID NO: 132 - protein, 191 aa, Homo sapiens
MNFLLSWVHWSLALLLYLHHAKWSQAAPMAEGGGQNHHEVVKFMDVYQRSYCHPIETLVDIFQEYPDEIEYIFKPSCVPLMRCGGCCNDEGLECVPTEESNITMQIMRIKPHQGQHIGEMSFLQHNKCECRPKKDRARQENPCGPCSERRKHLFVQDPQTCKCSCKNTDSRCKARQLELNERTCRCDKPRR

SEQ ID NO: 133 - protein, 290 aa, Homo sapiens
MRIFAVFIFMTYWHLLNAFTVTVPKDLYVVEYGSNMTIECKFPVEKQLDLAALIVYWEMEDKNIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERTHLVILGAILLCLGVALTFIFRLRKGRMMDVKKCGIQDTNSKKQSDTHLEET

SEQ ID NO: 134 - protein, 153 aa, Homo sapiens
MYRMQLLSCIALSLALVTNSAPTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFCQSIISTLT

SEQ ID NO: 135 - protein, 1956 aa, Homo sapiens
MEFPIGSLETNNFRRFTPESLVEIEKQIAAKQGTKKAREKHREQKDQEEKPRPQLDLKACNQLPKFYGELPAELIGEPLEDLDPFYSTHRTFMVLNKGRTISRFSATRALWLFSPFNLIRRTAIKVSVHSWFSLFITVTILVNCVCMTRTDLPEKIEYVFTVIYTFEALIKILARGFCLNEFTYLRDPWNWLDFSVITLAYVGTAIDLRGISGLRTFRVLRALKTVSVIPGLKVIVGALIHSVKKLADVTILTIFCLSVFALVGLQLFKGNLKNKCVKNDMAVNETTNYSSHRKPDIYINKRGTSDPLLCGNGSDSGHCPDGYICLKTSDNPDFNYTSFDSFAWAFLSLFRLMTQDSWERLYQQTLRTSGKIYMIFFVLVIFLGSFYLVNLILAVVTMAYEEQNQATTDEIEAKEKKFQEALEMLRKEQEVLAALGIDTTSLHSHNGSPLTSKNASERRHRIKPRVSEGSTEDNKSPRSDPYNQRRMSFLGLASGKRRASHGSVFHFRSPGRDISLPEGVTDDGVFPGDHESHRGSLLLGGGAGQQGPLPRSPLPQPSNPDSRHGEDEHQPPPTSELAPGAVDVSAFDAGQKKTFLSAEYLDEPFRAQRAMSVVSIITSVLEELEESEQKCPPCLTSLSQKYLIWDCCPMWVKLKTILFGLVTDPFAELTITLCIVVNTIFMAMEHHGMSPTFEAMLQIGNIVFTIFFTAEMVFKIIAFDPYYYFQKKWNIFDCIIVTVSLLELGVAKKGSLSVLRSFRLLRVFKLAKSWPTLNTLIKIIGNSVGALGNLTIILAIIVFVFALVGKQLLGENYRNNRKNISAPHEDWPRWHMHDFFHSFLIVFRILCGEWIENMWACMEVGQKSICLILFLTVMVLGNLVVLNLFIALLLNSFSADNLTAPEDDGEVNNLQVALARIQVFGHRTKQALCSFFSRSCPFPQPKAEPELVVKLPLSSSKAENHIAANTARGSSGGLQAPRGPRDEHSDFIANPTVWVSVPIAEGESDLDDLEDDGGEDAQSFQQEVIPKGQQEQLQQVERCGDHLTPRSPGTGTSSEDLAPSLGETWKDESVPQVPAEGVDDTSSSEGSTVDCLDPEEILRKIPELADDLEEPDDCFTEGCIRHCPCCKLDTTKSPWDVGWQVRKTCYRIVEHSWFESFIIFMILLSSGSLAFEDYYLDQKPTVKALLEYTDRVFTFIFVFEMLLKWVAYGFKKYFTNAWCWLDFLIVNISLISLTAKILEYSEVAPIKALRTLRALRPLRALSRFEGMRVVVDALVGAIPSIMNVLLVCLIFWLIFSIMGVNLFAGKFWRCINYTDGEFSLVPLSIVNNKSDCKIQNSTGSFFWVNVKVNFDNVAMGYLALLQVATFKGWMDIMYAAVDSREVNMQPKWEDNVYMYLYFVIFIIFGGFFTLNLFVGVIIDNFNQQKKKLGGQDIFMTEEQKKYYNAMKKLGSKKPQKPIPRPLNKFQGFVFDIVTRQAFDITIMVLICLNMITMMVETDDQSEEKTKILGKINQFFVAVFTGECVMKMFALRQYYFTNGWNVFDFIVVVLSIASLIFSAILKSLQSYFSPTLFRVIRLARIGRILRLIRAAKGIRTLLFALMMSLPALFNIGLLLFLVMFIYSIFGMSSFPHVRWEAGIDDMFNFQTFANSMLCLFQITTSAGWDGLLSPILNTGPPYCDPNLPNSNGTRGDCGSPAVGIIFFTTYIIISFLIMVNMYIAVILENFNVATEESTEPLSEDDFDMFYETWEKFDPEATQFITFSALSDFADTLSGPLRIPKPNRNILIQMDLPLVPGDKIHCLDILFAFTKNVLGESGELDSLKANMEEKFMATNLSKSSYEPIATTLRWKQEDISATVIQKAYRSYVLHRSMALSNTPCVPRAEEEAASLPDEGFVAFTANENCVLPDKSETASATSFPPSYESVTRGLSDRVNMRTSSSIQNEDEATSMELIAPGP

SEQ ID NO: 136 - DNA, 99609 bp, Homo sapiens
aaaagtgactggaaacagtgagtagaagtaagtcctttattaaaagccaatagagaacaggagagaggagggaagacctggatgggctctgcatcaagggaaagtttttaaagttggaggaaagttaagcatctttaaatgctgataggaaagagctggcagacaaggagagagaaaaaaatgaggtagatatgagataagatcctaagcagagggaaaggaatggtccttagaatgtaggaagatacctctcatgttgtaagagaagggaaggaggaaagaaggctgcagacacaggtgagttggaggtttgatggtatgaagttggcagagttctgtttttctccatgaactaggaaatatggtcattggcttactgcaagggaagacagggaatagtgagaaaagagtgtatttgaaacctcagactagaagaaactgctgactagggataccatatgattcccaggcaatactgaggttccccataacccctcagcagttcaggggaactgttctagattgacttagccttgggatttaggataagggtgagggagtggcaaaattgtggaccacaggtctaatctggttatggggaaaagtgttcagccacagactgaacctggaggtcccagagaaattggaggtcccaatgaaattctccaataatctggagttctccagtaacttggaggtccaaatgaaattcaaacaggtggagaaatgttgacaatgtcaataaataaaagattgtgataagaaagtagcatgagacttaagataaagtagactataaaccaaagtctttgatgaatatgggagagtgcctggaactcagtggtcctggaaatgaggagagagggcagcatggctaaatctggtggtggtggtaggatggtacaaagtggtgaagaagcaatgacatagaagcacatggggagcaaagacataaccctgaggcacctggaggagggttgaataaacagcctcccctgaatgccttgcaggggaatgggttcctgggaggagccaagtgtgagttcagggaggggccagatatgagggtgggagaagggctgttctgacaatcaagatgggacagatgagagggacagggccagtgggcaagctgtcacctctctgtggttatgtccactcttataagagtataaatacttcctgaagaagaatgagaagatggaattccccattggatccctcgaaactaacaacttccgtcgctttactccggagtcactggtggagatagagaagcaaattgctgccaagcagggaacaaagaaagccagagagaagcatagggagcagaaggaccaagaagagaagcctcggccccagctggacttgaaagcctgcaaccagctgcccaagttctatggtgagctcccagcagaactgatcggggagcccctggaggatctagatccgttctacagcacacaccgggtaagagctactagtaggaatgtctgctctcagctcttggagaggaagtctcggtcccacccagcccagaaagtcctccttggccctgggtgatgtggcagtctgctaaagattccgttaacaaccaaaaaaaatatatatatatatctctaacttatttgatgatctctttgaatttttatgacatttatgatagaaactaactaaacccacatcttcaaaagcagataactgctgcagagctttcagggaaagttggctgttcccttggatgacctctggcctggggcctccagaggagttgggtctctttgcaggtggagagcagacatcttgaggttgggggaggagcatggcggtgaggacagaaagcaggatgaatttaagccagtggtcctcaactatgatcttggaacccctggtgtccccaaaactgttttagtgggtttataaaatgaaaactattgtataacaatacttggatgtaatttgtctttttcacacactttctcttatgatcatacattggtgaatatagaggctattgatgggggatgatgtcatcactctaaaagctactggaatgtgtgcctgtatattcccgtgttttaaaatttcctgagttttgaatttctaatatgagatatatatacacacacatatgatgtatatatgtgtgtatacatctatacactatatatatacatacaactatgtatatacatacaactagaccatgtagctagttatgtatatataggtatataagcatatatacatatatattaatttctaatatgatatacatatatctggcataaacaaaaaggtatcaacataaacaaaagttatttggggtcctcaataaggtttgagagtaataatccctgaaatcaaaaagtttgagaatcagtagtttaaacaagagcttcttcatgacaattatctcacctgtgttgtatttttgatgttctacgagccaaaaaatggtgaatgcatgtttgggagttaggaggacaggaatcagccatctcaaatatggctagcagagtaaataaaaaggcactgaatatctttcttcctcctctcccatgccaagagttcatatcctcctaaatcctcagagggagaaaccaggagaggatttaagagacagagatgtagaaggtggagacagaagaaacattacaaaacaaggatggttctcttgtcagaagagaaattaaatgcaaccataacttcaccatcctgttgccagagtcctcccctgggcataacacctcttaccagcctgaggattggctgtctgtccattaaagtaccctcagtgggctcatcttggtgcactgtcagtcccagagatgaggatcttgctgagagggtgaggatatggcttttagtccttgatcctctctgcctctctgtacctgcatttgactctcattgacctgtagttcccagagcccttcttgctcataagcctgagataatgcctctcatgtttaaaaacatggttgtataaggaatcttgtttctcattggaggtccactttctgttttgttttgtttcagacatttatggtgctgaacaaagggaggaccatttcccggtttagtgccactcgggccctgtggctattcagtcctttcaacctgatcagaagaacggccatcaaagtgtctgtccactcatatcctttgcacgattgcctcttccacgtgttacaattagaccttgcctactgtgtccagtaccttctttagaggttagcaacagagcccttatccaattgaatcccaaaagtacaatgaggtcattagattgaaaaaatggcttgggcctttaatgtgtcccacaccccaaagcagtcccaagacacagaagaagtgtttatgcaacacacaggtggtttggattcacctcagactaatctagacacacctgtggatgcacaacttgaaaaacatcctctttatgaggggaggtttgctgatgcccccagacacattctcaccacggtgtgtggtccgctttccccacaacacaacaggcagtaagagggcccaagccttctttgggcagatgagataggcatgagttgttgctctgtgccatagccatgctgagaagtggctgcttactgggcaaaagagcagcacctcccagagggcaaggaaaacagaccatgatgggaagagcacacatagtctcaatgggacctcattggtcatggggcactgttaacatcacaaattactcaaaaactactagcaggtttaaaatgtcaataatctgatgttcatgccatacaagactgtaatgattagagacacattggtcaaatgtctactatatgaattgttttaggtaatgtcagaagctgctttcaggggattttgcaaggcaagccaaactagtagaaaaaagatactttggtttggtttcctaagatcttcctgggtgatcctaatggaaagatcctaatgacctaagatccttggtcatcggaaggattggaagttctttatgacaaatttagccctggcttgcaggaggttgatgtacaagaatacacctgcctcagttgcctgacaaatggtaaccagccttttcttagaaggcttcagtaaaaaagagttctaccctgctccctaactctgaggcagattgttggatttctggacagttgtcattgagctggtaaccttggcacagtcatctatctgcacactcaacatgaagctgcacagcttgatgaagttgcattacgttttctctttttacatttttttctttctggctggccagcaagaattacgttttctgagctgaatcttgaattttcagattctacagaaggatatttaatgacaatacagtctctcacttgctaaatacttcctaagtgtcaataccatcatcagttcaaaagcctctgaagtagagattaccatccccattttacagataatgaaactgacacacagaggcattaagtaaattatccaagaccatgtagctagttaagaagtccagcctgcatcctgcgtagagcagtatctacagtgaggaagtagggtggaaagtaatcagggtaattattctctcaatgtgtcgtctctgcttgggtagttgttgctttttcaaaatatatacaattacatggaaattacaaataaagagaaatcacaaacatacaaactcctctttatggattctggttgaattacatctggataagtaagaaacagctaattagaaataaaatcccctaaaaagaaccaagtgaccagtgaatattctcttcatcttgagatttgatgagtaaataattgcttggtagagtcacagctggacagaaaagctgttgagggggtctcttcctcacaaaagtctgcatttaaatctcataaatttggtaactccagccccaaaagatactagaattctcagggccctattattaatatttcaccaaaaatataattctaatcacatttgctatgaatgttttcataactaatattatacataagatatattacttttaaatatttgtagaattggagacacgattttagtttaatccttggattaacatttccccccatgtgagcatatttcttaatttaattgtaagtcagcaggaaaatgtggtttaattaatagaattttccttttcataatagatgtgttcctaagtaactgtaaaactagacacatcaaggcatttacagaaaactaaaatacatttaaatacttctgctcaaattgaaaaatgagtgttgtactctctctgtaggtcaagtttatcttcaagttttatttttccttaggaagcactgttgggagcccagctattcctaagaaaaatgtccaagtgggaacaatttacctttagattctccccaccaacatttcttcccttctattttccccttccacccaccttcctttcaatgtctccctccccttttgataatccctttgcccatagtctgctgtcaatattctccactctagctattcagagttctccactccagcctaatcctacttggggttttcttcctgagccagtatttcatttccctgtgcctgcctccaccgttcctacccagaagaccatttcctcggtggaactgatctcaactaagttacccaaacaatctgatgaaactaattcccatgaaagtttgtacctcttcacttatctccaagtttctaacttttctttgtcttttagaataaaaaagacatttgccagatgaaatttcaggccattttgtatactgaaatgaaggcttcggggcagaaggacattttggaaaagggagtctgtttccttctatcttgctcagagtttgttatcaaacagataagagttcacatctctgcagcatggttgactagctgcatgacctgagaaaagttatttaacttttattttttgtcagcctgtttctcagcttcaaaatgtagatatttatacccacctgtagatcagttgtattagaagtaacatggacaaagtactcagcctagcttaggcactcagtaaatgttagtggttattatgtgacaagatcataaagctaatattggctaagatttatgaatgtaatcattcagcatcaaggtgatcctagatgacatcacagagacttggtgatctcagcttttccttaacacaggcctttcaggtggttcagtttatttattacggtcactattttggttaattgtgtgtgcatgacccgaactgaccttccagagaaaattgagtgagtagatttgctatcattattgtaccatctctttttgctttcttttcttccttcacttggcagtctttgtcttttatttatcctgccatgcctcatgtgggtaatgctgaatctcattgtctatatgtctttgtaataaccaggtctctccttctgtgagatttgtttcataaacatacatgattttcagtttcaaagagatacagattagtggttctcaactttggctgcatattgcaatttttggggagattttttaaatgcctgagtcccagccccagaaagtctaaggtggcctgggaagatgagtctcctcgcccccacccccccccaacacacacacactcactcacctgctagatgcacacacaaatgtatgccttagagaaggtatgcttttgagaaggcctgctatgaaagagagacaggagcaaaactgagacagaactaagaacaaatggctctggagtatatttagaaaataactcataaatgaagctgtttaagttatcatgcttcatatgcctcaaagtaaccttagtattcctgaagttattctatttccctaggttagtgggtgaaacccctatagtttcagaatctgggagttttccaaaaacattccatatccacacatctgggagggatgcttccactccagcttgaacctaacatacctttggttataataacaggtgctttgcagagctttctttttttttttttttttttttttgctaatcataacagtaatgcatgccacaacagaaaatacgttatatttttattaatagattaaaggaaaaggatcacatagtcttcttaattgatgctaaaatcatttgataaagtttaatttccatttataattttaaattcttagaaaagttgaaatagaagggaataaatgtggcacatatacaccatggaatgctatgcagtcataaaaaaggatgagttcatgtcctttgcagggacatggatgaagctggaaaccatcattctcagcaaactaacacaagaacagaaaaccaaacaccgtatgttctcactcataagtgggagttgaacaatgagaacacatggacacagggaggggaacacactggggcctgttgaggggtggggggctaggggagggatagcattaggagaaatacctaatgtaaatgacgggttgaagggtgcagcaaaccaccatggcacgggtacacctatgtaacaaaccggcacgttctgcacatgtaccccagaacttaaagtataataattttaaaaaggggattgcatcactctgataaagggtattcattgttttaaagtatcaagcgtcatacttaattgtgaacatggaaagctttccctttgagatcaaaagaaaaaaaaaccaaagatgtctgttcttctcagttccactttgtaaaggaggtctcagccagcatagtaaagcaaagaaaaaaaaagtgcaagaagaaaaaagtaccgaagatgtaatttacagataataagattgtatacataaaatatccaacataacctagagataaacagtaagaattaataaaagagtatagtaaggtagctgggtacaaattaacatacataaatcaattgtgtatagacactagcaacaaacagaaaatagtttttaaaaataccatttacactggcattttaaaatgtcaagtatctaggaataagattatcaaagtataagtgagatctctataaggaaaattataataagtattgtgtaaagtttttaaagaaaaccaaatcagtggggagacatgttctcagattcaaagtctcaatattgtaaagactcccaaaaatgattaataaatttaatatgatcctcaaatcaatatttcaacaggcttcttttggtattacttgacaaactttaaactttaaattttcttcctcaaaagtttacatgaaattttaaagagcaaattatagccaagaaacttttgaggaagaaatacaaagtgggagaactcattctactggatgtcgagatttactataaagctctaattgaagcagtgtgccattggtgtaagattggtcagaataatgtaacagcatagacagtccataaacagaccaacacatatgtaaacatctaatgtgtgaaaaggtggcaccccagaacagcagggaaaaggcggtcttcaaaaaatgatgctgaagaattaggaatctcactggaaaaactacattaaacatccaactttgcaccacacacaagaatcaattctaggtggatcaacacctcacttgctttgtgaaatgcaaatatataaagcccttttttaaattttactttaagttctggggtacatgtgcagaaagtgcaggtttgttacataggtatacacatgtcatggtggtttgctgcacccatcaacccatcatctacattaggtatttctcctaatgctatccctcccctagcccccaacccctcaacaggccctggtgtgtgatgtccccctccctgtatccacgtgctctcattgttcatctcccacctatgagtgagaacatgcggtgtttggttttctgttcttatgtcagtttgctgagaatgatggtttccagcttcatccatgtccctgcaaagaacatgaactcacccttttttatggctgcatagtattccatggtgtatatgtgccatattttctttatccagtctatcactgatgggcgtttgggttagttccaagtctttgctattgtcaatagtgccacaataaacatacgcatgcttgtatctttatagtagaataatttataatcctttgggtatatacccagtaatggaattgctgggtcaaatggtgtttctggttctagatccttgaggaatcaccacactgtcttccacaatggttgaactaatttacactcccaccaacagtgtaaaagcattcctatctctccacatcctctccagcatctgttgtttcctgactttttaatgatctccattctaactggtatgagactccatctcattgtggttttgactggcatttctctaatgaccagtgatgatgagctttttatcatatgtttattggctgcataaatgtcttcttttgagaagtgtctgttcatatcctttgcccactttttgatggagttgttttttcttgtaaatttgtttaagttttttgtagattctggatattagccctttgtcagattgatagattgcaaaaattttctcccattctgtaggttacctattcactctgatgatagtttcttttgctgtgcagaagctctttagtttaattggattccatttgtcaattttggcttttgtcaccattgcttttgatgtgttagtcataaagcctttgcccatgcctatgtcctgaagggtattgcctaggttttcttctagggtttttatggttttaggtcttatgtttaagtctttaatctatcttgagttaatttttgtgtaaggtataaggaagggatctagtttcaattttctgcctaaggctagccagttttccccacaccatttattaaatagggaatcctttccccattgcttgcttttgtcaagtttgtcaaagatcagatggttgtagatatgcggtgttacttctgaggcctctgttctgttccattggtctagatatctgttttggtaccagtacctcgctgttttggttactgtagctttgtagtatagcttgaagtcaggtagcgtgatgcctccaactttcttctttttgcttagaattgtcttgactatgcgggctcttttttgttccacatgaaatttaaagtagatttttctaattctgtgaagaaagtcagtggtagcttgatggggataacattgaatctataaattactttgggcagtatggccattttcacaatattgatttttcctatccatgagcatggaatgtttttccatttatttgtgtcctctcttatttccttgagcagtgatttttagttctccttgaagaggtccttcacatcccttgtaagttgtatttctagatattttattctctttgttgcaattgtgaatgggagttcactcatgatttggctctcggtttgtctgttattggtgtatgggaatgcttgtgatttttgcacattgattttgtatcctgagactttgctgaagttgcttatcagcttaaggagattttgggctgagatgatggggttttctaaatatacagtcatgtcatctgcaaacagagacaatttgacttcctcttttcctatttgaataccccttatttctttctcttgcctgatcgccctggccagaacttccaatactatgttgaataagagtggtgagatagggcattcttgtcttgtgctggttttcaaaggaaatgcttccagtttttgcccattcagtatgatattggctgggggcttgtcataaatagttcttattattttgagatacattccatcaatacctagtttattgagagcttttagcatgaatgggtgttgaattttgtcgaagaccttttctgcatctattgagataatcacgtggtttttgtcattggttctgtttgtgtgatggattacgtttattgacttgcgtatgttgaaccagctttgatcccaggtatgaagccgacttgatcgtggtggataagctttttgaaaggaaaaaacaaagaggaatatctttatgacctcagactaagaaaaactttattacatatgacacaagaagcactaactatacaggaaaaaactgatacattttagtatactataattaagaatgttcatcagaagacaactttaagagcatgaaaaagcaagtgcttatattcagagtaatgaactctacaaatcaattagaaaaatgtcagaacaaccacttgtaaaatagcacaaaatttgaataggcactttacaaaagtggaaatccaaatggccataaacatatgaaagtattcttaacctttttttaaatcaaagagttgcaaattaaaatcacactgagattttattacatgttcatcatagaagggaaattttttaaagtgtcacaataccaagtattgggaatgacatggagcaacagaaactcacacactgctggtgggagtgtaaatttggacaacctctttggaaagcaaggggtattatctagtaaaggtgtaagcatacatatgctgtattcttctattacacccttaggtacctatgtttaacagaaatatgtacttgtggacaccagattacagctacaagaaagtttatgaacatttgcccataaaaaccccaaaccggaaaccactcaaatgtccataaactttgagtacattaactatttctgttatattctaaaatgagaaaacttacagcaataaaaattaataaactttagtgctgcacaacaataaggatgagtcttaagaaagtaatattgaacaaaaaaagccaaatgcaaaggattacataaacaaggttcatttatataaagtttgaaatcaagcaaaactaaactattttgtttaggaatgcatacttatgaagtaaaaagcatcaataaagtaaggcaagaaaaagtaccaaaaattaggagaatagtggcctccagggcagaagagggaggatgtaattgggaaggagctggtgaagtgctggtcacgttccattttatggcatgggtagttgtcacacaagctgctatggagtgaattttgtcccctcaaaattcaaatgttgaaacaaaccccccatgttgctatgttggagattgggcctctaaggaggtgattgggttaaatgaagtcacaagagtagagcccttaagtggtagaactggtgtccttataagagaaagagacagctttctcccctttgtgtgagaacacaaggacaaggtagacatctataagctagaaagagagtctttcccagacccaactatgctgacatcccaatctcaggcttcaacctccagatttgtgagaaaataaatttctgttgcataagccacccagtctatggtattttgttaaggcaacaaaggctgactaatacacaaacatttgttttaaaataattaatttatgttttatgtacatttttattatgcatgttacatatcataataaaaacccaataattttttaaaataaatgaccattgcaaaaaatgcagaacactgaaaatataaatcagaagatggttactaagtagagaaatcacaaaatcatgaaattatatttaatattgttgagatcatatagcatgtaaaatgtctatgcttcttttggagttttaatgtaaaacatttttttgcaaaatgagttatttgggagttatttggagattgtggttaaatatggaagatagaatgcatatgttttaccccaccctctcaaaatgccaatagaatgacagcacgggggaaagaacagtataaatatacaagaacaaagagaaagagaatggaaaacacagaggacaaatgatgtcaaaacacttggaagaccaaaagtgggtggagaagtggtaaatcacttagcagatcagggtttgttaaaccacggtgcctccagagggggataaaaatgagaataaaggcattttaccgcccccgctgcccaacaagccccagaggccctgcaagtgttgacatgatacaaatagcaagaaatggaagcagaaagaggaaagaacatgtgagcagagtatgttcacttactgctgcttctataataacaagaagttaaagagtattatttaaagttgacaaataaagaaatggacaaaataattacacttgacagtacaaaggtaagcacaaaaagatattattaaatacagtcagataatggataaaacagagaggaaaggaatcaccaaatggaaatgagagattttgattaaagaaatagtacactaaggacaatgtattacacggttttaattataattataaatttataataagtttttacttataaagacaaccactaggataaagatacaaactctttagtaatctatatatttgtaacaaataatatgacaaactctaaatactggaagaattgtacatcaaaaaataaaaagcaaataagagatgccaaataatgaaaaggtacaaaagtaattggggtttcagaccataaatattaaatcattataactaggctcaaacacatctttattaatcaaagtaggaaccattacaatcaacacatttttgccaatgagaaatgagtttgtttattcctgtagcataaaaatccatgctttgggattcaatgaactcttggaaggcattttctgcatcccgctggttatggaagtgtttcacctgcaaaaagttgttcagatgcttgaagaagtggtagttggttggtgagaggtcaggtgaatatggtggatgaggcaaaacttcatagcccaattcattcaacttttgaagtaactgttggttgtgtgacatgcagtcggttgttgtggagaagaattgggccctttctgttgaccaatgccagctgcaggccttgcagttttctgtgcatctcatcgatttgctgaacatatttctcagatgtaatggctttgctgggattcagaaagctgtagtagatcagaccggcagcagaccaccaagcagtgaccacgactttttttggtgcaagttgggttttgggaagtgctttggagcttcttctcagtccagccaccaagctggtcattgccagttgtcaagtaaaattcactttttatcgcacatcacaatctgattaagaaatagttcatttttgttgcatagaataagagacgacaacacttcaaaatgacgattttttaaacatttttccttagcttatgaggcacccatttatggagctgtttcacctttccaatttgcttcaactgccgaatgaccgtagaatggtcaacgatgagttcttcctcagcttcttgtgcagttgtaagaggatcaacttcgatgattgctctcaattggtcattgtcaacttccaatggccagccactactctcctcatcttcaaggttctcatctcctttgcaaaacttcttgaaccaccactgcactgtacctttgttagcaatccctgggccaaatgcgttgttgatgttgagttgtctctgctgctttacaacccattttgaactcaaataagaaaatcgctcgaatttgctttttgtataacataatttccatagtctaaaataaatataaaataaacagcaagtaataagtcattagcaaaaaaaaaagtgagaaatgcacattaaaatgatgtataacatggtcacatttatttaagaatgtattccaatatcaaacggcaaatttcaacaatgcaaaaaccacaattacttttgtaccaacctaatattttaaaaactaaatacgtcatatgaaataatataaacaagctaagactaagcaaatctgtcatgtcactaaatataaatggattttactcacctatttttaaaaatgcctattacattacaaagcaatacccaactctatgttgaataaaaaaaatactcctcacggtgatacagaaaggctaaaattatagaattcaaaagacataagcaaaggcaaacaaagaaagcaggatccatgattttaatatcagagaaagtggaatctcggtcaaaaagcatgaaataggacaaaaattgcacagacatattaatattaaagacgatagtaatctatatctttgcaacaaataagatggcaacaatatttataaatcagaaattattagagtaggaggataaataaaaacattgtaggaatagaaattttcaattaattttagccaataacagatcaaatgtattaaaaagtatgtaaaattatagatgacctagtaatataattaatataatgtatctgattaatatatagcaaactaccttccctaacaatagaaaatgcacctccttttcaaaaaaccaaacatatcaaaccaaatattaagccatgacaaaaacctcaataagctccagaaagtggaaataatatagaaaacattctctgatcataatgaaatagagttaaaaaaaataaccaaatttaatgaaatgagaggactttccacttgataatttttaaaaatctctcttaaagaattcttggacaaaagacaaactataaactaaaattatataatttcgagggaaggaaagataaaaaacagtttaatcagaacctagagagtgcagttaaagacatacatattcagggaataagtcacagcatggaagcatagaatatttatatcagtaaaagctgaaaagaaattatttaaagacctaacaaaactagaaaaaggataacaaatgaaagaaagaagttaataattataaaaagcaataaattacaaaatagaaaaacagtagatctaataaatccaaatgctgttgtaaaaatatgcacaagacctttatactaaaaaataatacagcattattgagagaaattttaaagtacctaaatgaattaaaggatgtctcatgtgactggattagaagattcataattgttagaatgtcagtgctgcccaaattagtctataaattcaatgacatccccaaaaaaatcccagcagcagctgttttatagaaattagctgaacagatttcatttgcatggatgaagtgaagtttatttaactattttcctattgatagacattcacatttatcataattaacataatcctcatattttgccaccacatattaattttttggtgagtatccttacacatgtatctttgtacacataatatgagtaaaattaaggatgaatttctagaagtagaattgccaggtcaaaggggtgtacattttaatttttgagatattgccaaatcgtcttccaaagttggatcctttccattcccagtaattatcaaatccattctttaggagattttgtattaactgaactgttgacataattccctttatatgcacactatgaaaagtataacatatacaaatctacctatatggtcacaatcctgggaatttatgtgacaggtattggatgatgttcagcatccttggcctcgtggaaataatcagactagattttctttttgaaatgcaaattgataatagccattagttgtttcctatgttgctgagaacccagaggaagataataaatgtccttgggatagactggggctccaaagatcatgctgtatacttttgaaaaagcattaaattgtagccagtgaggaatcagaaaccaatcttattgccatgttcttaacacaatctttttccttatcttccctcccttccattattccttgctgaaacattagctttgcacaattacctgctgataatggtagctctatgtctttctgcgtgcctgcctatctgtctgcttgtggaaagataaagatagatattccattttctaatcccctcttttgcttgggaagaaactagaggttcttcctcagattgggcaccagaaggtaaagagagcagggggtcaaaaattgttaagaagggcaagactagaactttcctactctccccatgccctggtttcagagaatcattgaaggggctctttgatgaccctaggacactcacctctaagcataacaatattctggaaaacctttgacaaattatagcaatttggttgtagagaagataaatgttttctcacctggcaaagaacatgtgaaatgaagctgaatctactgcaaacggggaagtgggtgtttaacactgcatgcataaagtattgatttgtatcttttcaaatttatggaactgttatcattttatatgtgtgctttatctgatgttttaaaattatgtttttgggatttgcccaaatggatacatgtagacctaattcattcattttttattgccatatagtattccataaagatattatcctgtgttttctcctcaaagttacagttttcctttctacatttaggtatttcaatctcctagaatttatttttgtatgtgtgtggtatgagataggcttccaatatttttccatatggattattccaacatttttttcaatacatcatttcccaagtggttcctaccactgcttctgccatgcaccagattcccatgtctactgaatctgtttctcccagtaatctcattgtcacatcctgagtcaacaccacgtggatttaaatgctctatagtaagatttgacctggtcgattcacatgcccctccttatttgtcttcttgaaaattattttggttcttgtttctttacttttccatatcagtttaagggtcacattttccagctcttttcttacaactctgtggaaactttgtttggtaatgcactgaattgatttatcaccacaggaagaatcgccacatttacaatacgaagccttcccacacatcagtatggcagatctcttaatttatacaggtcttctttaatatttttctacattttataatgtctttttcctaggtacattgcaattttggttgccctattgaatacttattattgctaaactgtcttaatattattaatttctatatagtgattttgcatccagcaaccctgctgagctccttaaagttaaatttttctgtagattcccttggacttcctatttagacagttatattatctgcaaataatgacaaacttgtttcttcctttatgattcttataccacttttttatttttcctgtcttattgaattggccgggaccttcaacaagatggtaattcaaagctatgacagtgagcatatttattttgctcttgattttaaagtgtgtgcttctaatgtttcactattatgatgtttatgagagtctcataattactttttatatcaattttttccatttcttgtttgttgagactttcatcatgaatgggtgttggcttctatcagtatttttatatttattgaggttatcatatagtctttcatctgttagtatagtaaatctgtaaactaacaggtttgttagtctatttttaatggttccagctgatcattttgctggattcaattaggtgtatttcattttatctattttgctaaatgaggctggcctgtaatcttctttcataaactgtccctttgggatgttccaactctctcctcaattgtccctgggaactccaacttattcttactttgtttagcagagcaattcatctctctccatctcctacaatgtttctcaacaagtgatctaaggatctctatgcacatataattttaaaatctaacatgtaagattaattattatattcatagaatttctaactttttatgttttcaaaaacagtgtatgtgcttcaaaaactgatttcattcataatggttaacatggagttaatcataggcagtttatcttgactaatgtattttattgtcacctgacagttatttacacttgtcagacttgcatttgccattattactgtcgctttgcataatatcacaattcaaaaaaaagagtcatcacttcgaaagtggttttctgaagcataacaataatgataaaaatagaaatataaatcctacaatgtgaaataaggtcacaatgtaagtaatgaatggcctccattgtaaaaatacaaagcatgaatctgtttgtcatgagacaagtggataatggatgtggataatctcccaaaaccagacaaaaatatataagaaaatgggagccatgacaatgaataatgataattgaattttattggaccaatgatccttttgtcctagtacccaatttattatctgctaacgtttttgtcaagtaatgatataaagctatcaaaacttccatattattttccaataaagtttatcaaccccacttttaaaccaattgaatatctctactacaagcacaaaataaggctttcccagtataaaattgtgaaaattttatgttaaaggttgagaagacaacaaaactatagagtcatcattcatcctcatatcaaaaataagcacaattgcactcctgctggtaagatacaaaaccagtttccaaatcaattacaaatattgtggttggagaagaaacaagaaaaacaattggtataattccttaattagaagtattgcattccttataatgtgactggcatttaaagtcaatgactgttaggtatacgagcagacattttattttatagttgaacaaaactatgaataagtaagttgtcagcatatcttcactatatatatgggaaagactcagtgactttttgttctatttatcatgaagctaattttaaaagaagagctctctggtttaattaaaaattagtttgaacctatgaaacagactttaaaaggtatgttggcttatgcactaatgtttgtagcagcgttattcacaatagccaaatatgtccatcaacagatgaatggataaaaaatgtagtatatatgtaaacaattgaatatcattcagttttaaaaatgaatgagattctgatacatgccacaacattgacaaagcattgtgctaagtaaaataactcaaacgcaaaagaacaaatgttgcatgattccacctttagtaggtacctagaacaggcaaattcatggagacagaaagtagaatggaagttgccagagagggggaatggggagttattatttaatgggtacatttctgttcgggattataaaaaagtttggaaacagatagtggtgatagttccacaatactgaatgtacttaatgccactaaattgtgtacttaaaaatggtgaaagtggtaaattttatgttatgtatattatgcatattttaccaaaacttttttttaaaagaggaaaggtgttaaattgccattgaagaaactccagccacatggtcagcaaggaaaggtatcactatccagatagaagatgctgctcccagatcccaatgctagtgcataccttattcacggaacgcagctgggggtctgtaatatgcctccagattctgatttgctgttgaggtacacagtggaaattgtgaatacaaactgattgtggtcacttagtgtacatctctttggcctactgggctgaaatgaaaagtgagtaagagaggctgctctcccacactgaattgctttggctggcaaatgggaagggcttacacagagttttaaaaataaggaatgaaatgttttaaattaccatttttatgaatacaagttgggtatctcagtgatccattcagaatttgaatattatgaatctttgttttcagagcctgaatatcgggatttgtaacaatcagacatcagtggtgcaagtggctcaacggctgagaacttgactttttcccaatacccaatgattttcttcattcaccagaaaaagcacttaggaaataacacattgggcttattaaaaattacatctgaatgctgcaacccaacatcaagaaataccttgcagagccaaataccaccaaagagaggatgcaactccattagctgctgttgagctggggcacttgccttctggtgaagcactgaaaatagtctttagagagcactctctccataatttctgggtctgtgtttgatttgacaaaccagaaatatccatcaaagcttcccaacaacctataattctgagttaagattttctaatttagaaaacataaagagtgtgggggggaaaccaacaagatatggaagctgacagctcaagcagctatgcaaccagatatagattcctaaatgatttcaaacacgatttctcctctcacagatgtgaaaaaaaattattcactttttaacttgacttttacttttatttaagacatatatgttcataatttaaaaggtcacagagttttataaagattctgacaaaaaaaacagcaatttcatttttctcatctcttctttccagaggccaccacttttagctttttttacctgtgtcttctgatacctccctatctccaataatatactcataatactaatttttaatttttcaatttctgatgttatttattggcttcctattatgagaaaaaacttaaggccacatccacaaactcatttcctctcaccctcatcttcctgttacagttatattgtaatcttcagttagatcatcagataatatatccattgtatgactacatatataattacattacattgctaagtaaacactgtttacagctgtgtcatgcagtgtactttgactatatttcctttttgcacaatgtttttgctttccttggagttaataaggattttatttttttgtttgctcagttttctatttatccctaatttgttcccaaactcttctccagatgtttaattgttgcttcaatttatttgcacacatcaggtgcatgtgtatcatttttttcctatgggaatcacagctagagtacttcatcttctgcctcattctgacctagatgttttctaggcctgatgcacagctgttttctagagattttttcttcttcattctttttttggattccttttgcctcttccctggatcgcatatatgtttcttgtttgaatggagcatatcctctagtaacatttttttttaagacaaagtctctctatgctgcccaggctgttggcctcaaactcctgggttcaagtgatcctcctgcctcaacctcccaagtagttaggactacaggtacataccaccatgcccagcttctagtaactttattagaagggtaactaagaagtacatttcccaagacttcatatattctaccttctttgacagtttggctagggaaagacttctgtattagaaattatttccctcttaattttgaaggccttgctcattgtcttctaatttctttctagacctcctattagtcaaacaatatacctcctagtctgattctctaattttcaaactttttatcacttcctatccatttctgcttttttgttccacttcctgtgagatttccaaaactttatttacaagtccgcctattagtgttttacttttgctatcatatttttgttttcaaaattccattttgtctttgaaggtactttttacatccttctgctcttgttctatacgtggagcctcttctcacctcttaactctctaaaaatattagtacaggtttttttttttttgtttttgtttttgttgttgttgttgttgctgttgttgttgttgttttggagacgaagtcttgctctgtcacccagactggagtgcagtgacgcgatctaggctcactgcaagctccgcctcccgggttcacgccattctcccgcctcagcctccggagtagctggaactacaggtgcccgccaaggcgcccggctaattttttgtatttttagtagagacggggtttcaccgcgttagccaggatggtctcgatctcctgacctcgtaatctgcccgcctcggcctcccaaagtgctgcgattacaggcgtgagccacagcgcctggccaatacagttttatttctctaactcttcttctgccctctttattgtctctttttcttttcttttcttttcttttttttttttttttcagttgtttggttgctttggtttctggtgttagaagcatccttcaaattcctgatgctccttggctggctgttcatgttaaaagtgcagcatcttcatgggctctaaaccagattatcttctggaaacttaacgaggagcagaagtgaatagggaggggagttgtttgcctttcagtaggtaaacttttctttatatgcatttttcagtatgcaactgtttccctcttcttcaactcttaagaaaatgagcatccaatccatttctggagcagaaacagtttctcattgaatggatggcataaagcagcatctagaaagctcaactggttcctgtaaaaaactttcaagcaattctttcagccctacttatcaccctcccccaaaccttgctttcagagatacttagcatctctaagttccaagcagttctggggctctgcagcatagcttggcttgcttctgggtattccctgcttcagccagttttcagctttcttaggtctgctctgtcagttaccactcatcagtctgcactccagtttctaaaaactgggagtttttagatgagcctccagcttcttgcaggatagggaggccctggcagacataaacaggagaatccttgctcttcacccgctactgccctctgcctaaccccagaacagcagaagctgctggctgtcccagccacacacatccctccccactccatctatttgtgtggcccttctttttccctcagtctgtgtcttgtttcctctccttaccttcttccccctcatcaccttggtgatattctttgcatgttttttcttggagcagtcagagcaggtcatccctccctcctggaagaaggaaccccctgagtacactccatggcacagttgacactccttttctaccctccttcccagatatgtcttcactgtcatttacacctttgaagccttgataaagatactggcaagaggattttgtctaaatgagttcacgtacctgagagatccttggaactggctggattttagcgtcattaccctggcgtgagtatatctctatgcagatctgcatgtgtgataggagaggggacaaaatggtgggtaggagacagggctaacatgcaggtcccacttggacagagtgtggagactcacaccatgaacgtttgctccaagaaccactgcaggaatataccaggagaactgaaagaattcatagatccttttaaataagtggcacactgctggaaattctgcaagacaggtgaaaaactgtgagctcccaaagtgtgagggggggaaacctgcctccaaacatacatcccaactgggtaatctgaaaatccagatcacaggagaagaatttacccttacctggaatgtaaataaatttaggaagccacacaaaatataaaagtagaaacagcaaagggaagtgccttgtaggcactcccagtctccagcttgagaccagggaatccatccctgactatgtctcacaggcacccttggggaaggcagccagtggaatcagggaggggtcacaggatgaaagaagtttcaactaaaattagtaataatttcaactgggcacaaattttcttgagcagaatccagggggcaaatgggaactgcaagcagacagtgagggatgcggtccaaaagtcatgctttctttctcagtggggaagctcacagcctggggcaaggtctgagtagggcactgcaggagcaagaccagcctcaccaactacatgagagctaggtgaggcctctcactagcagctatcccccacttccctggagaactctatggcacagcagaggcagccaaaattccctctggaacacaaccccactggcctgagaaccaacccccatccaccacagtggccacagcaatccctacccaagaagggtctgagtctagactcacctacccctgcccccacctgatggtatttccctacctgccttggtagctgaacacaaaacccagaaactctcggaagctttatggccctgctcatcacctaagaaactaaaatatttaccctggccaacttagggtgagcttagatcccccttctactaatgcactagtgctctcttgaaagcatcacctaccggctggaggtcaaacagctcaggccattaaagcaactcatgacagaataactttgatcccaggaaaaagaaaacaacaaccagttgcactgcctgcaacatcctggctaaccagacgtcctgagtctgtccatatgacaacttcactgctaacataactagcattcaagaaagccagcacactaaatctatctacagcctaggactctcacagactctacttcattcctctgccaccttcaccagaacagatgctgatatccatggctgggagacttcaagatcaatcacatcacaggactcttgcaggcatttcccagtactaccccagagcctggtagcccctctgtgtggctaggcccagaagaacaataacgatcactgcagtccagctctcaggaagccccatccccaggggattggggagagcaccacatcaagagatcacccatgaaacaaaagaatctgcacaacagccattcagttccagatcttttctctgaaatagtctactcaaatgagaaggaaccagaaaagcaattctggtaatatgacaaaagagggttcaataacacccctcaaaagatcaaactagctccccaacaatggatccaaactaagaagaaatctctgaattgccagataaagaattcagggctgggcacagtagctcacgcctgtaatctcagcactttgggaggccaaggtgggcagatcacctgaggtcagaagttcaagaccagcctgaagccaacatggagaaaccccgtctctactaaaaaatacaaaattagctagatgtggtggtgcatgcctgtaatcccagctactcaggagactgaggcaggagaattgcttgaacctgggaggcagaggttgcggtgagctgagatcgcgccattgcactccagcctgggcaacaagagtgaaaatccatctcaaaaaaaaaaaaaaaagaattcagaaggctgattattaagtgattcaaggagacaccagagaaagataaaaaccaacttaaagaaatttttaaaacaacaagatatggatggaaaattctccagagaaatagatataaagaaaaaacaatcacaacttctggaaatggaagactcacttagagaaatacaaaatgcagtggaaagtttcaacaatagactagaacaagtagaagaaagaacttcagagctcgaagacaaagcttttaatagacccaaactaagacacacaaaaagaaagaatttttaaaaaaatgacaaatcggccaataaatttggaatcatgtgaaacaaccaaacctaagaataatgggtgttcccaaggaagaatagaaatctaaaagtttggaaaacttatttgagggaataattgaggaaaacttccctggccttgttagaaatatagatatccaaatacaagaagctcaaagaatacctctgaaatgtgtcacaaaaaagatcatcacctaggcaaatagacatcaggttatctaaagtcaagacaaagaaaagaatcttaagagctgtgagacaaaagcctcagataacctataaaggaaaggttatctgatttacataagattaacagcagatttctcaactgaaaccttgcaagccagaagggattagggtcccatctttagcctcctgaaacaaaataattgccagccaagaatattgtatgaagagaaactaagcttcataagtgaagacaagataaagtttttttcagacaaacaaatggtgagagaattttccactaccaagccagcactacaagaaatgctaaaaggaattctaaatcttgaaataaaaccttaaaatacaccaaaatagaacctccttaaagcataaatatcaaaggacctataaaacaataacacaataaaaaaaggaattaaggcaataactagcataatgaatagaagagtacctcacatctcaatactgatgttgagtgtaaatgccctaaatgatccacttaaaatatacagaagggcagaaaggaaaaaaaaaatccaccaaccaagtatctactgtcttcaagagactcacctaacacataaggagccacataaacttaaggtaaagagatgggaaaagatattccatgcaaatggaaaccaaaagcaagcaggagtagctattcttatatcagagaaaacagaccttaaagcaacaacagttaaaaaaagacaaagagggacatatataatgataaaataattggtctaatggaaaaatatcataatcctaaatacatatgcacctaacactggagctcccaaatttataaaacaattactactagacctaagaaatgaaatagacagcaatataataatagtgggggatcaatattccactgacagcactagacaggtcatcaagacagaaagtcaacaaagaaacaatgaacttaaactgtaacctagaacaaatggacttaacagatatttaaaaaacattctaccaaacaactgcagaatatacattcttttcatcagcacatggaatattctctaagatagaccacgtgatagataacataacaaatctcaataaatttaagaaaatagaaattatgtcaggtatcctctcagagcacagtcgaataaacctcggagttaactccaaaagaaaccctcaaaactatacaaatacatgaaaactaaacaatctgctcttgaatgatctttgggtcaacaatgaaatcaagatggaagtttaaaaattttttgaactgaatgataatagtcacacaacttatcaaaacctctgggatacagctaaagcagtgctaagaggaaagctcatagcattaaatacctacatcaaaaagtatgaaagaggacaaatagataatctaaggtcacacctcaaggaattagagaaacaagaacaaaacagacccaaaccaagcagaagaaaaggaataacaaagatcagggcagtactaaatgaaattcaaataaaaataataataatacaaaagataagtgaaacaaaaagcgggttctttaaaaagatatagaaaattgattgaccattggcaagattaaccaagaaaagaagagagaagatccaaataagctcaattagaaataaaatgggagatattacaactgataccacagaaatacaaaaaaaaaatcattcaaggctactatgaacacctttatttgcacaaactagaaaatttagaggagatgaataaattcctggaaatatacaactgtcttagattaaatcagaaagtaatagaaactctaaacagaccaataacaagtagcgagattgaaacagtaattcaaaaattgccaaggaaaaaaagtccaggagcagactggattcacagctgaattctatcagacattcaaagaagaattggtaccaattttattgaaactattccaaaagatgcagaaagagggaatcctcctaaatcattttatgaagccagtatcaccctaataccaaaaccagaaaaggacttttaaaaaagaactacagacaatatccctgatgaacatagatgcaaaaatcctcaacaaaatgctagctaattgaatccaacacatatccaaaagataacacaccatgatcaagggggtttcataccagggaggtagggatgatttaacatacacaagtcaataaatgctgcacgtcacataaacagaattaaaaacaaaaatcatatgatcatctcaataggtgcaggaaaagcatttgacaaaatccagcatcccattatgattaaaaccctcaaccaaattggcatagaagggacatactccaaggtaataaaagccatctatgacaaatccacagccaacattataccaaacagggaaaagttgaaagcattccccctgagaactgaaacaagacaaggatgcccactttcaccatttctatccaacatagtactggaagtcctagccagagcaatcagacaagagaaataaataaagggaatccaaatcagtaaaggggaagtcaaactgttgctgttcaccaatgatatgatcgtatgcctaggaaaccctaaagactcatccaaaaagctcctagatctaataaatgaattcagtaaagtttcaggatacaaaaacaatgtatacaaatcagcagcactactgtacaccaccagaaaccaagctgaggaacaaatcaagaactcaatcccttttacaacagctgcaaaaaaaaaacaaaaataaaaacaaaaaaatcttaggaatatacctaaccaaaaaggtgaaagatttctacaaggaaaactacaaaacactgctaaaataaatcacagatgacacaaacaaatgggaacacatcccatgctcatggatggataaaatcaatattgtgaaaatgaccttactgccaaaagcaatatacagattcaatacaatttccattgaagtaccacatcattcttcacagaaatagaaataacaaccctaaaattcatagggaaccaaaaaggaatccacatagccaaagcaagactaagcaagaataacaaatctggaggcatcaccttagctgatttcaaactatactacaaggctatagtatagcctgtaccaaaacagcatgatactggtataaaaataagcacatagaccaatggaaaagaatagagaactcagaaataaagccaaatacttacaagcaactgatctttgaaaaagcaaacaaaaacgtaagtggggaaaggacaccctattcaacaaatggtgctgggataattagcaagccacatgtggaagaaagaaactgaatcttcatctctcaccttatacaaaaatcaattcaagatggataaaaggcttaaatctaagacctgaaattataaaaaattctagaagataacattggaaaaactcttctagacattggcttaggcaaaacgttcctgaccaaggacccaaagcaaatccaacaaaaacaaaaataaatagatgggatctaattaaactaaaaagctgttgcacagcaagagaaataatcatccaagtaaacagacaacccataggatgagagaaaaatctttgttatctatgcttccagcaaaagactaatatccagcatctataagaaacacaaataaatcagcaagaaaacaaacaaataatcccatccaaaagtgggcaaaggacaagaatacgcaattctcaaaagaagatatataaatggccaatgaacaggaaaaaaaaatgctcaacatcattaattatcagggaaatgcaaattaaaaccacaatgagataccaccttactcctgcaagaatggccataaccaaaaaataatagatgttggcatggatgtaatgaaaaggaaacaattttacactgctggtgggaatgtaaactagtacaaccactaaggaaaacgttatggagattccttaaagaactaaaagtagaactaccatttggtccagcaatcccactactgggtatctacccagaggaaaataagccattattaaaaagacacttgcatatgcatgcttatagcagcacagtttacaactgcaaaaatatggaaccagcctaaatgcccatcaaccaacaagtgcataaagaaaatatggtgtatgcataccatggaatactactcagttgtaaaaaggaatgaaataatggcattggcagcaagctggatggagttggagactattattctaaatgaagtaactcaggaatagaaagtcaagcatcatgtgttcttaattacaagcaggagctaagctgtgaggatgcaaaggcataacaatgacataatggactttggggacttgggaggaaaggtgagacgaaggtaagggataagagactacacactgggtacagtgtacactgctcgggtgatggtgcaccaaaatctcagaaatcagcgttaaagaatttttctgtgcaacccaacaccacctgtttcccaaaactattgaaatacaaataaagaacttattcatgtaaccaaaaaccacctgttccctcaaaactattgaaataaaataaaataaaaagatttgcatgggtgtccatgtggggcttatgggtgtatccaggctcacactctgaagaaggttcttcatctcagttcagcttcctcatttggaattgtatggcctggggttcttgccacagagtaccgcttcgggggttgctttccaagattagtcccatgcccatgaggagatgtcagagacctcaaatctgagataacagttagcctgtcacagtggatcagaaaaggcccagccttgtacccccctgacatggcggtctccttctgagaaatcagtgtctgaggagactggttggtcaaactcctgtgtttgaagatccgtccacatgcagtgttgcctagatcacaatgcatcttctcaaagggtccactctgaaagatgttgcaataatgaaatcagtgtcagtgtcagtctatagatggcagtgtcactagattctaagtgtccattctgcatcctttctaggctaatgataccccaggttatccttatttatgctgcatgcatccccaggacccttgcttgcagagatgctgactaacttctggtcctacagatatgttggcacagcaatagatctccgtgggatctcaggcctgcggacattcagagttcttagagcattaaaaacagtttctgtgatcccaggtgagcatttattcacagagcatatgttggttttcacagcctaactcccttctctaattttcacaagaaccctgtaaggttccagggcaaagactattgtccccacttacaagacaaaggaactgaggcctggagtataggaaacataaacccaaggcctcttcactagtaagagacagtgtgacctggaagcctattgtcccaactcctaggccagtgctcttcccacataccacatggcctcacaatcaatacgtaacaggaggggcatgtcttcactttctgttctggttgtgggattcaggcaagacccctcagttgaatttttatttataccttaaactaaaggattaaacttggaaatggggaggaagggagaaagcagtcccagtatcttcactgtttccgtaggtctaaaatcctgtctttagacacccagaggaaaaaagaattaggcaattcttgattactgagaattcagaaacaaaagtagtccatcaaagctcattgtgtggggcctctaagatctccactgtcaccagtagcccagcgactactcttcagcccccatgaggttgatggtgaggatggggaggccagagacaaggcaaactttctgaaatgggacttgatgcttcccctctgtggcctgataggttctctcctctcaccccaagaattcgttctcttatctgtaaacagaaacacccattctagagtggaagtcttttctaccatttcttgtctggctctgcagggaaagataggaaactctctgccaattcccactggacacacctcttgaagagagccctggtcctgccccttcatatctctctcacttactctcaactgggaagaccctgagtcttatttgcaagacctggtctgtccatactgtctcttctgcctcatctctcacctctcctcacatctcaccatgctctggaatccacctacggttctgcaaatactccacaccattgctcacctcccagccttctactgtgctgccccttcttctgggatatccttcctcctctctttactcaactcacactcattcctcagggctctgccaaggttttacctcctccctggttttcccaccttcctcacactccacccaccccattcccacctctggaacttcagttaagggctgctcccctgtgtgcccatctgctcagtaatgctacagactttcccctcaattgtcagacaacggcactcgacatgctgctgccttagccatcactcagctcccagtccagggactgacacatgtagtgctcagtggattatttgctgaccaaaatgactaaccaaaaataaatcctagattgcttccctggtcagagctctttctgctacctgcgaagctgctctcccaaagaagttgattttacttaccagagcaacaaatcatccctccttaaacaagcaggtgtatccttctttgctgccagctgtgcttggcacaagttctatttatgccccagtgactgtctcagtgtttcttatagtctctttctattgctaaactcacctctctgtttctctgtgtctctttctttttctttctcttggtctatttttgtttcactctatctctcttgcatctctctctctctctctttctctctctctctctctctctctctctcacacacacacacacacacacactcacacacagtgaggttcatgtgtcccaagtctcaagctgcctcccagatgcatgcagaaagacagatgccaaattactggggtgaagttagtagcttcatgcctagcacagtgcctggaaaaagtaggtactcagcataaattatttaaattgaattgctagtgtcaggaattttattagcctcaagatgataaaaaatgcattgcctgggtctcagttgcatcgtctttataatgagaatagcccctgactctctgcctgcctctcagagtaaatgcaagcttcggatgagaaaggtcttggaactgccctggagtgtgtacatacttcactcctgtatgtagagatgaaggaggatggctaagatgaagaagtgtgctccgtgtgtgctacctcatccatgtggtcataccactgtcatcttcccgcaggcctgaaggtcattgtgggggccctgattcactcagtgaagaaactggctgatgtgaccatcctcaccatcttctgcctaagtgtttttgccttggtggggctgcaactcttcaagggcaacctcaaaaataaatgtgtcaagaatgacatggctgtcaatgagacaaccaactactcatctcacagaaaacgtgagtggagtctcttccatagggaccaaggtctggttggacccttggtatcatatagggacaggggatatggagcccctgtgtgtgtgtatagacatatattttgactcccctttcctgccaaaatggttctcttgagttgtgttttacttttgggtattctatttcctgttgctcagcatccctcttgcaaggaaatgagccataaatctagaggcaagtcattctacctctgctgggggagattgagagccgaagtcactgcttagctcttctcttttcagatgtgactttacaacttccatgtggcccagcatgcccactgagtacatgtagccaaaggagctcactttggaagacttgggaatattgcattcaccacacaaggcttgggttggagggttcagaaccatctgtgaggctttcttttcttcctttcttcagcagatatctacataaataagcgaggcacttctgaccccttactgtgtggcaatggatctgactcagggtgagttcccaacttatgacaaagcacgagtgcccaacaattccttctccatcttgtccttggcatattatgggcacagatggggttgcaggtcctgggaaagatgtataaataaataaatcatggcctttgccaacccagagctcatggggagggaatgtatgagttagctttcgctgtgtaacaaatgaccccaaaattttgtgaattaaaacaacaatgtatttaattcatgattctgtgcatcagcattttggactgggatcagatgggcattgggtgacattgactaggctcattcatgcatatgcagacagcatattaacttggagatggctggtctaggacgtcctgtctctgctcatgtggcctctcacccccaaacaggttagcctgggcctgttctcatggcagtgttcccagaaaaacagtggaagtttgcaaggcttcttcaggcctaggcttagaaccaacacaatgtaccttttgtacattctgatacattcttgactaaagcaagttgcagtccagtagagatccaagagacagagaaatagacttcatcactcaatggaaagagctgaaaagtcacattggaaagggtgtggatacatagagacaagaattatagccattttaataaataatctaccccaggaaggaaccaatacttatttgtgtcaaatgctctacacttaatcatcacagctaactccattctatagccacattaccctcacaagtagaggaaaaaacacatgtatcagactttgcaatttcgaattcttacagaggccagattcataacaacaaatgagtggagtgggccaggagggaacctaggagctgagagttcatgcctcctctaaaggggacagccccactgctcggtccagcttttggttgccatgtggaaatgtgggttcactgtttccagctcttccaacttttaaaatagagataggaaatttagatttttatataaaatctcccaaccgtaaacattggctacctattccaaaaaatgtctacatattgttgggccaaacaaaatatttctgtgggccaaatccagcctataagctgctagtttgcaatttctcattcatagacataaagatgctaccctgtggaaaacaagttctttactagaggcttcataggctgggcaaacacagtgaggtggcggtgtgaggcaagagagaaagtagggaaggcttcctggaggtggtgtttgaggtgagctttcaagggcaggtaggatgtctccaggctgggtgaatacgagatagtttcagcgaagaccattccaggtggcagaacagaatgtgagacaaagctaagggatgaggacccctcagctctgcctgctgctttggccactggaggaaggcatgagcagaaagactttaggcaaaagatcaaaaaggcccatctcacccacctccatggctgagagcttggaaaagcagagctcacaacacccccagtgcctgagaggctgacggctccatgttgcccaggtcgacctgtgtggagcctgcatgaggctccaccttcatcagctcactaggaaaactatctcagttggagctgaggactggaaacaagcaggagcatttggtcaacatcaggttccttggactgttctttcacaaatgcacttggcatttggttctttggctcatgagagggttgttctgacatcagttttcatttgcctttgacttaaatgtaaaccaagagcccctcagcatccttctgtctagataatggcatttctcaaggcaatggctccagagcagctcaagtcctttttgtggtaaagttgttgggtccatctacacacctctacagctcagctccctgagaggccaggcctgctattgggcaggtgccagccaggcagtgggggagtggaccaggctgggatggcagagagaggccagctcaggataacggacagagtgaaccctgccggggcatgccgtgaaagctaaacctgggtcctctgtggggctgcagagaagccagagtcctgaggaaaggcccacattggccaatggcactgtgggaggaaggtcaggggtctcaaggcagaaaatggataccagaaaatagttgataattttcagtgttcttccacatatattattccagtttatcctttcagcagcttccaaggttaaaaacaataggaattttcctttgcagtttatatacaatatttactatgcagaagtgcaagacactatacagtgatctcatttaatcctcagagcagtgaactgtttatatgcagtggctatggtggatttctacagaagacatagaaacaaggctgccctcagagttaattaagaaacctacaggaaatgggttgcctagccccttggaagagcaaaccaagagcctatctttaaatgtgggtctacaaagccagggaacttgcaatcttcaatcgaagtggagatagacttggaactgattagaattaagttgtcagagctctaatccatggtatgggttgttcacatggatgtctgggataaggagagccccagaggttggagttcatggagaaatcctgggagtaaaagaattccatgtattcacaaggaatgcaggtaaataaaacaggagaaaaagaaaaaaatttaaaaaaataattctggacttcaaacgaggcattgctgtttcattgatcaggccatctctgctagggtggatgagagcactttacgctccctgagctgacagatgcttcttgacatcgactcatcctcctattatgagagagaggaaggagttcagcattcccacctcaatactcaccaggcagtcatttttaatctggccttccttcataggccatcttcaggaggaggctaggctgactcaagtattgggctacttgacagttatatttctccttttaataaatatattgacacctgcgtagttttaggcaactgacttctttctgacccccagattccttatctgtaaagaaagaacattgagtgattaaattatagtgtttgtaaagcacttaaagggagagagaagaacacagaaagtgctcagtaagtggaaagtgttatttccactgttacatataattaatcagtgaacttggctaatgtgagacctcccttgatagacaactctgcagatgatgccaacaggctcaggttttaagtctgcgttattgctactgactctcatttccctggtatgaactggcaaagagcttatagtatcgtgtctgggcagtcagctgccttccccaggccactcccctgtgtatgaaattctgacgtgaaagtattagcgtccccgttttatggataacagaaaccaatacctaaacagaccaagtgtccaagatcatcctgctaataagaggaagactaggtcttgaactctgatctctgacataaaactctgtggttgtctcgcagccctgggctaccttgtctgcaataagcaggggatgaccttctctgttcttgctgcagccactgccctgatggttatatctgccttaaaacttctgacaacccggattttaactacaccagctttgattcctttgcttgggctttcctctcactgttccgcctcatgacacaggattcctgggaacgcctctaccagcaggtactgagctgcattcccccacgcagacttggttggaggctggtgggtcagctgcatggctgtgcttttcctggaggaggctgacttaaattcaggggtccatgtgctatgggtacaggtttctcttctttcccttgaacctgcagaccctgaggacttctgggaaaatctatatgatcttttttgtgctcgtaatcttcctgggatctttctacctggtcaacttgatcttggctgtagtcaccatggcgtatgaggagcagaaccaggcaaccactgatgaaattgaagcaaaggagaagaagttccaggaggccctcgagatgctccggaaggagcaggaggtttgtgaggagtggaagctttgtgaagaaggttgcagactgtccattcttggatactgttctggactagccacttcaattagggcaccgtttagggagctataggaggaatcatcttgcctcagggaccatattagatcaggttttctcaaagaagaagctaagtgaggattcttgtgcaagtgacctattgagggagtgctctcaggagaaagcgaatgaagcaaaacagaatggggcagagggtggaactaaacaaggagtgttctcagctagagaccagcttcagcttgatcccatggggaactctggggcatgacctgtaccacagttagtcctaccttgaggcaagggggccagctttttttttttaccctccccatacctatcccagaagcaggcagccaaaagagactttttttgtagaatgctgcaagtatgagccatcagctgctgccatgcaagcagctcgggatagctgtgctgacctggtgaaagggatctgggtggggcaccaacagagtaccccatgaatgagtgggggtgacccgaggtgtctgttcctgccatggcctaatcccaccaccaccctggtcctaacccttcagcttctctgtttcagatctctcacccctggcaccccatgtctgggggacacattcatgctaagtccaagcaaatactattggctacacctgctgttctctcttcgcaggtgctagcagcactagggattgacacaacctctctccactcccacaatggatcacctttaacctccaaaaatgccagtgagagaaggcatagaataaagccaagagtgtcagagggctccacagaagacaacaaatcaccccgctctgatccttacaaccagcgcaggatggtaagaggctcaggtttgtgctctaaagattacccaccattgcagctgccgtagacaatgagttggagtgggaagaggtgtgtggcagagaaagagctggaggcatagagcctaaaaggatccagacacccctccaaaatggtgtcttaaactaggaaagtgtaattatagatggggaaaaggggtgaattataaggacaccttagggaagtggatcaacaagattgggattgtggactgtggaaaaaggaaaggggagtccaatttgactcccaggtttcaggattgggcaatcaaatgggtggtgattccaagatgaggacactggaggaagaaccccggtttgtaggaaaggtgggaagcccatactgaacatgccaatcttaaggtgtctgcggacatcaaaggtcagcttccttctgaggctctggtctgcagttctagagtgcaaggttccctgtccgtggtgctgagatccttcatgcaccttttttttttctgatgcgtcgaggtggtttttatttttttacttagttttttttaattgacacttcacaattttatataattattgggtataatttctgacctccttcctaaggtcctgcaattcaagctgtcacctgttgttatcagaaaagtttccagcacccatctctgtgacacaatccagcctgggaatggcttcagcacctcacctcagaccctgtagcaattcttttccccccataataactttctgcctcccactctaaaatttgcactgcaactttcctcgccacgcttcctcccaccaccttcctgccccttgaaagtccttttaccccaaatatgccctttctataggtctgacagataatatctgctgtgtgggagggtggctccacactaacagtgtggaaaaggggatcaacatggctatttttttatgctttatacctctcacttccctctcaatctcttttcctgtgctaagccgaaggatattttacttttttgcaataccatctctccaaccctcagatttatgtgtgcatatacaaacacagacacacttgcatgcacactgacctcatgacacatccacacttcagcatttatctgcatctgtgccctcctctttcttgctttgccccttttgagcagcacctggcatacatggggcacagttcagacaatcacagaacaggatgaatcacagcttccatggaaatgtcaatgacactgaattgggctttaatttcccccattctgtcagccccacacagattagcacttggatgtccaataattggtatgtgtgcttgtctctccagtgatgcttactttcaaagggaaaaaagaggagctgtaacttgttcattcaacaatactaggtgcttggtataaagagatgactagaacatgttcttttccctaaggatttccatttgggtggaggaggcagatataaacacagctatgtgttaaatagtgtattagagacacatacatggtgttttgagaatcagggaagaaacatccactcttatggggctggataggtatcagaaaaggcttcctggaggaaggcataattgggatcaacaataaatagcatgtaggggttcttctagtaattgaagacttgagagagtttggggaggagtattttcctggcagaaagaacaacatgtatgtgcaaagacagggaggcaccatttaagtacttctttaatgctaattgatttattggagcccactcaggaaggcatcctctccctcttttcccaggtacattcatgtggtaaatagacctaatgcagtttttatctaaagccattttataaccaatagaaattaaatagaggaatatatagaagagacccaggagggtttttgtggaaaatcacagaccagttggtctcgttagaggatgaattttaaagcaattctaatgcttatactcagaagacattgcccaccatttgtcaaaaccttaattctaaaataactcgtggccaaggagacactgctgtcaaatatgcaaccaaaattttcttctcagtttcttcattggtttgcttggtgctcaagtgcaaataatgtagtattcccttccttaatatggatgtgtcaatttttctcatttgcttcaaaaattggaaggatttttgcattttatgagttctatagtccttgggcatgtattacaggcagagagtactctatttataatactgagcttttaataatggttgctaaacaggatcaggcttcaaattatcaagagaggaaacttcagttctgtgagataaggggattagtaaggagaaccccaattggcaagattctccactttagtagcttagtaataaaaaggagttaaggaaggtgagtggaataaatcggtatgatcagagtttggtatgaagtcaatgtttagattttgtacatactatagaccacctgaggacacaaatgatggtttattatggtcaagtttcactatggtcatgggaactacctaacccagcacactaattctctgagggctctgggtttatgaattagctcttttctctggcaactttaagccacacagttccctcaatggaagattttgatgggaaatgtttattgatttggaggaatgacattattcttccaggaaattaggctgcaacccttccttcagtctctccattgttgactgttcaagcctcgagggatcctagaaactcattgcactgtacagctcttgtctcctcctttgcaacacaaactctcacattcatacagatgggatctaatgaattgtactacctaattttcagacaatgaagtgcacttattcattcaacaaccacttaccaagtatgttccagtactggtgtgcatagtagcctccttaggtcacaactttgcatgtggaaaagtgaacttaggacagctttgtctagccctgtggccaaaggttggcaatcaactgaactatccaggtgacaaggtttcctctgacatgttcctgaccatgataacctatttgctgagcatcagcacgctgtaatctctcctctctcctggtctttcccggagtctatctagagtctccttttttctttttccccaccatgcatacctagaataccccttagatttgtgcctttacttagtgactgaaaggtcataaagacaggggcagggaaatgggagtaggtagagggaagtgttgggctctagatttcccagaggaccagtttccagccttcttgctcctttggggcaatgcccagtcttttctaggcctcgcctctggaaaacgccgggctagtcatggcagtgtgttccatttccggtcccctggccgagatatctcactccctgagggagtcacagatgatggagtctttcctggagaccacgaaagccatcggggctctctgctgctgggtgggggtgctggccagcaaggccccctccctagaagccctcttcctcaacccagcaaccctgactccaggcatggagaagatgaacaccaaccgccgcccactagtgagcttgcccctggagctgtcgatgtctcggtgagtttgtgaatgcttcagactccctcaggctgtcttccacctagaagccttgagccaagaagcctgagtatcaccaatggaagggatctttagccatcatcctgtccaatgcctccccattctactccttttttacagacatagaagatgagacccagagagagagagagattgagttggcctgaggtcaaacaggtttcctggtttattctgcagtagtgatgcaaattatattccatttgaccccatatttcttatcagtgcttctctgtccccactcaacatcactgcctcagtgataggcctgctttcttgttggacaggtatgagaaaaactgaaggacccttctcttcctgcttatggctctatgcaaactcttctaggctgggcaaatggcacccagagaaattcaggaagtttcttaggacagatctgaatagaagcacagtattccttgctttactcacagaagaaataatttgccaaaatgagcaaattaggcaacagtgactaactggccagcactctttaatagaataatcgcagagtgtaatggcaagtcagggattcctcattggattgggagctgtgagttaatgtgagctctcccctccagtttcagcaatgatgtttctagtgtttttcatttgccctctctggctagccagggatacagcgcaattgcagacagaattgtaaagagaccaataaatggttccactgatacagataagtcttagagttgccttagctcagtctctgactcaatgtcatgtgattcagggtcccagcaagaaacagatggaccactccgatgggctaatagagagagtttagtaaagtatttacagaggtgtgggctgggcttagggaatgaataagggacagtgaggcacctagaaactagtaacagggggaagctgttacatgcctaggctgaagggatgaaggaaaggaccagaattagactacagcagcagctgccctcatgtgtcagagaggctgcctggcagaacttgtgatcttagtagaggatcacagctctgctactcagccatagcacaggagagaagaagccaggggaaaatacctgacttgtctctccttctatccttgaatgtcctgcctatgtctcccattaaccaaacctggccagaaccagagggtaaggataacacattttgtacaggtctccctccccaggaacagagacagtggagaaggtagagagtaggtctccagggcaaatggaatcaccaaaacagagccttaaagtcaaaggcatcctgcagggctcgctgggagtgcattagcactctagaaaatgcctcactgaaggcatttatgcctctcttgtgatgggcccccaccctcctttctctgttcctgagattatcatgtgtctagatattctgaccttgattcattctagttaaattaccaggctagtgaaagattgactctttaggcccttctgtttagtatggacctatattttagtcccaactgtgccagttaccacctgagtcacatttagcaagtcctttaaattatccaagcctccttatctccccttgtaaaaaggtttctaaatagctggagggttaaatgaaataacaaagtgcctacatttttatacatgtctgacagataacaataaatagtgactactagtatcatttgcttagtcctcatggttggaagctttataaactttctttatgtttattaactgtttatacttacagtattcagcaataacatgctgtacagatttgtagcctaggagcaataggccacactatttagcctagatgtatagaaggctatagcatttgtttgtgtaaatacaatgtaggatattcacagaatgatgaaatcacctaatgatgtatttgtcagaacatatctctatctgtaagtgacatatgactatatatgagattggccaataagaggctgaatgatccaactttgccatgaagatgtcaggttaaaggagcgtcctgactctgtttgtgtctcaacaggcattcgatgcaggacaaaagaagactttcttgtcagcagaatacttagatgaacctttccgggcccaaagggcaatgagtgttgtcagtatcataacctccgtccttgagggtaagtgctgctcactgcattgttcatccactgtgtcatgatgaattcccatgtgagcagcagaagcaatgtctctaactcgtgtcaaagcgtccatctctgtgtactggaattcctaatactcctcattcttatgtcttaggccccaccatcttttatcaatgtggttttttagatgcataatttttcaaaaacaaaataatttgatgaataaaatatcctagctcatctcttgttcaaattagcatctgctttgcatgcatcacaaaactagatttttaaaagtgatctggcaggcatcagagaatttcaggccagctctccggtgtacaagaaatttaaccatccttaattttccaacatggcaaaattatccttttcatggtttcataattatatttttcatggttgtaacttacacagttgtaatttaatttcttgttcaagcccacattatgctgaatattggtagacaatttaagtccattaatcagtcaatttaactaagtccttgttaatttagaattctaccaatcaagtgggaatccactcagtctccccagcaatgtatctaagttccaagccaaagggtagaggaagagagtggcaatggtcatggccacctatccacacactttgccatagagcgtgattgcatccctctaaccttgagcaggaggtctgttctaatccagcctttttttgccttagggtatggagaatgcaaccttcatcatttccagttatcttactcccctagacaaattaaactgacctaggctggaggagttgtaagggagcttgagtgctggtgtgcccctgagaaggagtcctgtgtgttttcctcccagccctaggctgaatcctaatttgaggggaagaagtggtgagcaatagaaaccaaaaaaatgtttgagggatttcaaaacagagccaatgtgtgccctactttctaggtaaagccagaggtggcaagccttagagagagattcacatgcacagaaactgtagagtagaactagccagtaatttaccagatatgcagagatgtatctgttttgctcacagctggatctccattacctagaagagcagtgcattaacaaaggtgatatctggggggtgatgctactttatagtggtgtaaactgataaaaaggaagaaaataaggaatagtcaggtatcttggggtaggatagacttccgctcaaggaagatactgtgagagtagagtaagaaaggcaggagaaacaaagacgtttttaagaaaatctggggaaaggcaaccttagcttaggtcaaccttaggttagagaaggcctgaagcagcctcagagagagccctgtggctccagaatggcagagaggagctgggtgatgacttagcccccagtgaaggctatggaaaaagatgagtgagacccatagagggaaactagagagagaagagccatcttcatggactctcccaccagggaccagatgggagctacaactcaggcaaaatacgcttagcaatgacaaaggaccagctcaactctcctccaggtttgagccctacaaaactcagacacagactcagatattgaaatagtacccaacattgacttaacaagagacagttcccatggtgaggacttgaagcataaattgaattcaactaagttacatttcttgcatacctgagtttgtgctttgagaaatgtgtactcatttctcaacaacaacgtgtacagactctcttctattattttttctcattgataattatttaatatcactgttcattgtaatagagtctgtacttctaacatttttcatggcatagaatttgaccaagctgctattcccacaatttctttcttggccagataggtttcttggtttttgtttgtttgttttggtttttgttttgctattagtcatcaaacagcaaacattgaatacaaacagtttgtttttttcatttattctcgaaaactgttaagcttcctccttctctcttctttcatttattctcttatcaacaagcatttgttgagcccctgttgtgtgtgtggcattgcttcaggtgctgggattcagtggtgaactgatataagcttgcgctcatggaatctacatcctagcagggaaggggacatgaaagatgaatagatattcagatataagaagtaggagaaaaaataaagtaggaaaggagatggaaaattctctccaagaagaacagaaatttgaattaaataaaggaatcagctatgtaagaagctgaggagaaagttcgcagacacaaatagcaagtacaatgcattctgcaagaatgagatagcaacaagcaaaatgcatgtcccaaacacatcccagtgtaggtaagacaaaagaaggtcatgggatgaatgagaggcaacagagggtagtagttagaacactgctctggaacccggctgcctgggtttgcatcctagctcttccacttatggtacacagtgtgaccttggagcttcagtaacttttctgtgcctcagatttttagcctgtaaagtagtgagaatatacttatcttgtagagttttgtgaggattaaatgagtcaggtcaagcaaaatgcttagaaccacgactggcatgtagtaaatactcatcacatttggctattatgatttactaggttgtaaaatctatgagggcggagatgtgtctgttttgctcacagcctgacctccattacccagaagacaagtgcatgcacaaaggtgatatttgggtggttggcggcgggagtgatgctaatttataacagtgtgaactgataaaaaggaagaaaataagtaataggcaaatatgttggggtagggtagacttcccctcaaggaagatgctgtgacagtagagtaagaaaggccagagaaacaatgatgttttaaagaaaatctgaggagaggaaaccttaggttaaataaaagaggtcaaagttttctgagcatagggcacatcatcttctctggttggatgttatattcattacacacatgagacacctgaaggatgcttcatgctgccagagtcgtaataggatttataaaggccacctctttaagagggattatgcttaagaaagtttggcccaaaccaacaggagtttgacaattcactgaactcaaagcatgtgaaccttctatgcttggcatgcaagctgagatttcactgttgtccaagccagaattccagaagctgggtcacagcagtgagcttactggagtggtgagtgccttaaagaggaagtgcaggatactaagtgaaatatggtaagatttgcctggagccagggaattatcccaggctgaaaggactgcaaagcagaagagagaataacatttgaaggaatgaaaaagcctaatgtagctgtaacctagagaaccaggagaactgaaaataaggctagagggatgagttggggccagatcccaagaaactcctagactgcattaaggatatgggacttcatgctaagaggagtgaggtgccattaaaggattggaggcagggaagttacatttgcattttataaaagttactctggatacttgtagatataagaggggaagtatgttgtcagggaaaccagttaggaggaagccaagtacaagatggcagtgcttgaactctggggtagtgacagtggggctgatgggaaatggaaggatatgagagctatctaaggggcataagattcaggacttgatgatgcatatggttctggtataagtgccttaagatatgctgatacaataactcataaagggagcattttaggggaagaagggggctttaatggggaaagatgaaagaagattatgagttgagtctgggatatattgggtttcaggtgcccttggagcatctaggtaggggtgtccagtaggaagttgactttaggatataggggtctagaacttagatgacaaagatggcatatatatatatatatatatatatatatatatatatacacatacacacacatatatatatgtatatatatatatttgaaagcagtttgaatgtaagtggtaattttgaaaagatgcaactggatgagttaacacagaagggttgaagtaagaagagaagaaggcctcagacacagttctaacaaactaaatgtttaatagttaagcagaagagatggacccagcagaggagactgaaaaggaaggtacagaaataggaaaagatctagaagaatacaatgcagagccaagagtaaaaatttcttcagaaagaatagaaaggccaacagaggcaatgctgtggaaaggtcaggtaaaatgaaacatgaaaaggtccaggggctttagtcacatggatgtctttggtgatctaagcaaaagaggattaatggagtaaaagggtaggcagaggtcatattgaaggggcttaaagagcgggtgagaggtgaagaaatggagatatggtgtacagacaattttttcaagaagtttgcctgtgaggaaaaggagatagtaagatggcactagggagtagggagaattgaaagaagactttttggtttttgtgtttgggggagtttttgtttgtttgtttgttttgagcatatttgcatgctaatgggaaggatctgggagaataagagagactgaagattaagggaagaaagggtatattcaacagactcctgcagtggcaggagagaatgcacagtggagacactggtgttaacaggagcagggggacctctttaagcgtaacaggatgaagggaggaaagttctctctgttatcaattttatataggagatccttttgaggtggggccatggtcatgttttaagctggcaagtagatacttttagtctctgtgtctctgcaatcaatcaagttcaacaatgtcaaggctgtttacaaagatgcctctcttttcccatcatgcctcacaggtggctgcttcctgccaaaatggcacatctaaagtgtcctcattcatgactacttcctgtgcttctttttagtgccaaaataggtccagggaagttcttgcttttgttccaaacagggattgttgattttggtcccaggatgtgccaacttctttagagaactatgctttgccagtttggacatctgtagtttctaaaatccagtcagtgattaaaacagcatgacagtgaaaataaatagtctgatctgtggaagagaaatggacatgtgtatatgaaaacacatgaacataaatggtaataacatgacaaaaatgacatttcaaatcttgggaaaatgaaaaattattcaataagtaatgttgatataaataatcagagacaggaaaaaataaaccacatcaatatcttactctttacccaaaataaatttcaaatgcaccaaagttttaagtgaaaaaagtgaaactacaaaagaaagaaaaaaacatggagaaggtattttccaagccttgtagtgagaaaagcttcatatgtaaggcatgtatgcatatgtggctaacctgcataatgtgcacatttaccctaaaacttaaagtataatttaaaaaaagaaaaaaatttaaaataaaaaaatgaagaaaattgaaaaaaaaagaaaacaaataaaaatactactgataaatcttgactacatacacatttttaaattatcaggaaaaaacactgttagcaaaatttgggggcacacagttatttctctaaactgatttttcaagtgcatatagtaaaaaaaaccctaaacactgcaagtgtgtatgcaatgacaactatgtctccttcccactatagacccttcctgctccccagactcctggtgcacccccctcccactccagtttatcttatattcttcaagcaatgttctatgcatatataagcacatgcatgcacatacacacactacacatacatatttttctacatcaccacaaataaatctgcctcattctttttcacaatgtattatgctttatcagttgttgttttccattattattataaacaatggacatcatctttctttgcccacataggctgatatctgttcaagatgcatgtcttgccgaggaatttatagataaacctaaagctaagaaattgccctccatcgaggtgaacacagttacacatccacatggagatttaacggaggcaggtagagagataagcctagtgttcaggaagggatcagaaattggacacataatttggtgggaattggcatagagatggttttttagggctatgagattcaaaaacacagagaagctaaggtgagaatgcttgagttattcaacatttacaagcaggaaaggaaaagggagacaaaaacagaaagtgaaaagaagtggagaaatatgggagaaaaagcaagagatgatgcagtccccagagccaaatgaacactggtttcaaagagaacaatataaattctgtcaaatgttataagggtaagatgagaactggaaatcaattatttgaatttggaagcagttaaagtcagattccaggggctgcagagaaaaaaagaggtaaggagctgtagaaggttaagtgtagaaaactcttgcaaggaattttactgtcaaagaagcagtaatgaaagagagcatggggtccagagagactttttcaaagccgcgagataattaaagcatgtttacctgctcatggcaatggtctggaagggagacaggtctggatgatgcaggccttgaataggtgggagaggaaagagcccggcacaagtgggaggggtagagccacccacgcactgtgtggggcacgaagacagaataccaggtggacttgcagatatgccagagatttagtggtaggaagaaggggaagttcttttgtgaactagtctatattctgagtgaaataaaagggagctcatcaacagagagtaagtagaaagaagagccggaggttagacgggggaagaggaagtgagaaacagtcatctggaagaatgaaggaatggaatataatatagaaacacagccagatttctgggcagggcaaggctggggctcacagatctctaggagggttggtaagcatagttgtgtattttttccagccaggtccagctggttgggtgcaagtacagagtagtctacaaattgggtctattcacagttcaggttttgccaggcaagtacaatgaaggaggagaggggcaaaggaattgagggtgcctacaagggagtagttagagagatggatgtgaaatctaagctgggcaaattgagaagtaaggacatgatataggtgatgggcagtaaaaatatgtaatgtcagcagtttaaaggactggatggggcagatattaattggagttgcaggactaaaggagttcaaaatataggaaatgaataccagagacagagagagggctgaagtcaaaatgttggaggtggtacttattattaacaacaaggtctagaggatgaccgcagaattggggtccaaggtgacacatggctgacagctgtcattgaccacactataatgcagaactcgaggagtctgaacagaagtgcccaccctgcttgaccagcttgtctcagaagtatctgatctgggattgctgccccatgtgggtgaagctcaagacaattctctttgggcttgtgacggatccctttgcagagctcaccatcaccttgtgcatcgtggtgaacaccatcttcatggccatggagcaccatggcatgagccctaccttcgaagccatgctccagataggcaacatcgtgagtgctctggctggtactgccctcactggcgtggtcggggcggggtggggatgatggcagggtgcagttcgggtggggtggggcatgcccttattggttagtgtgttgagccagttagctgagagcagagcagcagtgcaggagacatgtggacactgggttcaggaggtcaagtgtgggaggacccaggctgagctggtgggaatggctttgggatgaacaagcacaggaaagtgaaccaggagagcctggagccagaggcagctagttgccctttacaaaacataggacaaccacttgaattttctggatctcagttgcctctaccttgaaatgaggataaatgtcacttttttatctaaagacaatctttggacttgtctgtttccttccaatgtaattacttttatgaccacaattaacagtagccacgattttcaatgttgtcacttaaggagaaaaagagttggggagggaaggggaagacagtggaagggaggaaacatggaaacaaggttgctgttgtaacaaaagcatcaggaagtcggaacttttctttggcatctagtttagacatcatgctgctttaaattttcctccatcacttgttagtattatttactcttaacaagatacaatccatactggatttcactatatactggataaagtatctgactcagagggacaacaactgctccaaccttgccccacccacaggaatagtaataatactcagatgcttctcatggattatctcattttattttcacaacaaccctacatggtaggcactcttgttattccctttcccagatggaaaaatggagatgcaaaaggttaaataatcttcccaagatcatagagttgagtttagtggccacatcagaatttgaacccagacagaccggctgccaagcccgcttttcttaacccctgaattaagccacctcacaagacttgcgtgtgtgtgtgtgtgtgtgtgtgtgtgtgtgtgttcaaacacacgcacacatgataggcagaagctagaaagggtcagcatcctgccttcatgtccgcagcagggtccaccaagctggaggtgacctactggattcaccagaactgtctggctttggggtccagcttcttataggctgcagacttaggtggagggggaaggcccagaggaaatgtgactacttgtccctagaaaccactccctccgccataatccagggctgtgaaaggggcagcagtaggttctggaacatggtggaatcagcatgcctcatgttttggcagcacctaggctgaggtcacatcctaaagttgatatgaaaaggaaaaatggaaagagaagagaatgcttattcccaagaagtcagcctaagaccacagagggccttatggaatagacatttgagcccacaccctcattctacagttagaaaagtggaagcaagagagagaaaaggcctttcccacagtgtcagaggaaagtgccacttttttaaagcaagaaagtcatgtgcttggtgcctgcaatgagtcaggtgctttatgaatgttatttcagtgtcacaacaacattatgaggttaacatcaccctcacatgacaaaagagagcactaagactcagagaggttaaatatcctgcccaaaattgtatagctggtgagggtggatccagggtggacccaggtctctggaagacacaagacctcaaccctaccccccaccacaccacactgacttgcctacaagggacactccatagatactctttgaatcagtcttgtggcatgagaaagtcacttaaactctcagcctgttttcttctccataagaaggatgcattgtctgtttctcaggctggtgaggggctcagataaaaagatatgaaggaaaagcacctgaccctggtcgttgctttcctccttctctgtctcccttccctgctggttgttgtgttacccgagcctggttctgacctctctcagtgtcagaattctgtcctatttaagacaattagagacacacagagcctaaaagaatcttagaggcaatgaatcattgttcttactagtcactgttacttatgaatgaattactgtctgccaggccctttgttaagaactgcacatgcattggctcattttatgcccattatacagatgaggaaattgaggtacaggaaggatgcattatttgtccaagcttacataagctaggaaatgtctgggctgggattttaatccaggtctgtgatgtcccacaacccacacgttttaactactgaaccagactgactcttcactgacaaaatgatattataataatgatcttaaagactatccgcttattccactcccaccaccattcacgtggaaaaactgcagcatgcacagcccctgagaatggtgcagaaatgtctccattctgtcacgttgactgttaccctggccaatcctcaggagcccacagataacatagcaactgaacaaaacaaaaggattttctattttgtaaataagacattttcttgctgccatttttatcattgcctccgaccccacagatcccactgtgatgaaagcttgtttccactcctaggtctttaccatattttttactgctgaaatggtcttcaaaatcattgccttcgacccatactattatttccagaagaagtggaatatctttgactgcatcatcgtcactgtgagtctgctagagctgggcgtggccaagaagggaagcctgtctgtgctgcggagcttccgcttggtaatgtttttctcttgatggcttggggaaactcccacccagattcagggaagacactgtgctctggggactgcaccagccagctcccccttcctctcctgtccttgtgggagggagcagggtctgactcctgggcgactggagacttgggtctgtggccccagcttttcgctgactcagagtggggacatgccttctcctttctgggccttggctcccttatctgcaccaagaggggacttccaagcactgtcctcgtctcttatcaaataacaataacagcaataatcacagcagctaatacttactgagcacttacaatgtgtcaggcatagcactggacacttgaaaaaacgcacctcattttatgctcacaacaaccctgagagatagtcgtttttaagatcctcaggggtgggtgaggaaaaagaatggttccatgatgacccgaaagtctcccatctgccaagcaagcgaataagccacagacctggatctcaaatccaggttgtctgactccagagccccagctccttccagcctcaaggaagtcattctctgattcccttgtgcccgaaatcacagccccaatgtctcaagcaccttcaacctgcctattagtctcactcacatgcaatgatggctcttctctaaactcagctccaggacgccctctacaggagaagtgccacaggccacccacttttatcagagccacaggtttgtcagccaaacctgtcagattcccaggagtgtcgggtcactaggtctccaggccatctggaggaagcttggcatctcactgactcttgggaataggaaagaggcctgaagaaatgtcacggcttgttagcgcaggccgcctgctctcaggaatctctcagtattaactgggagccctgcatctagacttgaagagaggtgacaaaacaaaggggagtatccaacaatcttcccaaggtcctgacaagtgttggcatccagaggttgaagggggtgcatggttcaggaggcaacgagactctaggacagatctgcttgggaccctatcacaggggccagtgagacagtgctgagcccctgaacttggcgtacctggattaggggtggcaaactcaaatgcccatgtgcagtgacatagagccagccatggaagagatgtgggcactggatatttgcctcaggtagacaggcaaagatgactccatttcacctaggcagacccaaagcagtgcacaactcctgggagggatgtttacatagaaatcaatgtgaccatctcaggccaggtgcagtggctcacacctgtaatcctagtactttgggaggccgaggcaggcagatcgcttgagcccaggagttcaagggcaacatggtgaaaccccgtctctacaaaaaatgaaaaaattagccaggcatggtggtgcacatctgttatcctagctactcagaagactgaggtgggaggatcacctgagaccagggaggtggaggctgcagtgcaccatgatcgtgccactgcactccagcctgggagacagagtaagaacctgtctcaaaaaagaaaggagacacagagagagaggaataaagatagaaaaagcgagagaaagacagatgaaagaaagagagagagcaagagggagagagaaagaaaaagagaaagaaagaaagaagaaagagaaagaaagaaagaaagaaagaaagaaagaaagaggaagggagggagggagggagagagagagggagggagggagggagagagagagggagggagggagggaaggacgagctatggcctgtccattattgtcagagttactaattttccaaaaaagtcagaaatccagatttttgtgcaaatgtctttaatattggctactaatccagtttttaaaaacactctaaagaccaaataaagcatgtcctgagacacagctgtgccatgaaacgctggttgatggcatctgcctaagctgatggtactgtcaccatcccagggaggagaagggtagagtaggcctggtaggactctttatccataacttgaaaatcttacaaggtcagaattaaatcacatttttagaaggacagatttctctaggtatctagaaattgatgtcaagatgtaggcccctaagctaatggtcaatataaggtacctatgcacaatcgtcaagagagcaggagatatcacacccccataccctggcaggcccacagttagttttctaataaaatacgaggctgggcgcggtggctcacgcctgtaatcccagcactttgggaggccgaggcaggcggatcacaaggtcaggagatcgagaccatcttggctaacacggtgaaaccccgtctctactaaaaatacaaaaaattagccgggcacggtggcgggcgcctgtagtcccagctactcgggaggctgaggcaggagaatggcgtgaacctgggaggcggagcttacagtgagccgagattgcgccactgcaatccggcctgggctaaacagcgggactccgtctcaaaaaaaaaaaaaaaaaaaaaaaaacgaacatttctgctacacttggggaagcagaagcttagtgttttaaggtctatgtgctacttttgttctgatcccacagtctaaagtcccaaacaaccaaaaataggcaagtttacttcacagtctgcccctacaggattctgcaggggaatgctaccctgtccccacctcgctgatttaacatgctgatcagtgctcaattccctaaccacacccaccaactacacactttcttgggatctattccacttccctcatgacctagcttagatttcacagcccaccaatattattatgcccttgaaaacaaactcaatcaccttttccctctgcctctttgcgtttttgtgtttgccaaaacctcaccggagagtctaagtcaaatatttctctccaccttgtctgcacctgagctgtgagaaatgctggagaaaaatcaccgccagctggtcagtttcctggttttaattaatagactttattttcaggacagttttcagttttcagaaaactggagcagattgaacagaaagctttcatataccatcaatcccacaacacacacacacacacacacacacacacacacacacacacacacagagtttccctattaccaacatcttatgttagtacctacatttgttacaaataacttcactggtttcccattgctctgagaataaaatccagactcctcatgatggtgtacaaagttctgcataatcaggacctgccagttcaccagtctccgtcttgcccactttgctccagccaaaaaggcctactctctcttcttcacacataacagagaacttcttggctttgggcctttgaagtttttttcgctgtgcctggaatacttttcctttagtcttcacttagctcacttattctcaaactctgtgttcaatgcacttgtcacctccttagaggggacctccccaaccacactatctaaagttggattccttcatcaaattaacctggcatttacaattgtcctgctatcccatgaggcaaaaaccagagtttcttgtctaccgttttatcccaagggcctagcacaaggcccagcacatacataggaactcaataaacacctgttgattgattgaaggaaggaaagaaagagaggaaggtggagggaaaaaggaagaaataaaaagtctgtcttccttctctcccaaaatagcattgcttctcctcccgtcacttaaagccttgctccatttgctctgttagtccattggtctatcctggcaccaatatcagtcttaattatggcagctttaaatatatctgtgtctgtaaatcaagtaatccacctaatttacttcaagaatatcttggcctgcacactttcatattcactttagaattatcttgccaagttacatacccacatacacacaaaactgctattgtttttcccattagggactgctgtaattgataggtcaatttgggaagacttataatctttacataattcagtcttctgatctatgaagatagtatacgctgtataccagtctttcaataaagtttaaaaatgtttccatgaggtttttataattttctccataggatcttgcatatcttcttaaatgttcttttctggcatttttggctagcattttgatatttaacatttttgtatctagaaatgtctcttattaattctaataatttatctatacaatgttttaaattttctaacataatcacatcatgtgaaaataacaatgagtttaatttcttcttttctttcttttttttttttttttttttgagacagagtctcgctctgtcacccaggctagagtgcagtggcgtgatctcggctcattgccagctccacctcccgggttcacgccattctcctgcctcagcctcctgagtagctgggactacaggcacccaccaccatgcctggctaattctttgtatttttagtagagacggggtttcaccgtgttagccaggatggtctcgatctcctgacctcatgatctgcctgccttggcctcctaaagtgctgggattacaggcatgagccacccacgcccagcctaatttcttcttttctaatccttatgccattaggttctttttactagatcactgtgctagttaggacatccagtacactgttgaaaagaagtgttaataacaggtatctttatcaattttctgatcccaaaaagaatcctttcaatatttcaccacctctaacaattgtggcaggctttttttaaagataagaaatctttatcagttcaggaagttctcttttatcaagaatatttatcatgaatggatgtttaattttatcagacaattattctacatgtattgagataatcatgtattttctccttcaatctgttaaagtggtgaattatattaattgattttctaatgttaaatcaactttacattcccagctcaaacctagcttgatcgtgatgcattttttaatacattggaagatttagtttgctaaaaatttgcttaagatttttttatccatatcaatgagtaatatttgatctataattttcctgactttcattgtccttgccaggttttggtatcaaggttccaagattatgccattttttttttaaagccaagggggccaggtggggtggctcacgcctgtaatcccagaattttgggaggccaaggtgggaggattgcttgaggacaggagttggagaccagcctggccaacaggagaaaaccccatctctactaaaaatatataaattagctgggtgtggtggcacacacctgtaatcccagctactcaggagggtgaggcatgagaattgcttgaatcccagagacagaggttgcagtgagctgagatcatgccactgcactccagcctgggcaacagagcgagactccgtctcattgaaaacaataaaaagaaggccaggggcagtggttaatgcctgtaatcccagcactgttggaggcgcaggcaggcggatcacctgaggtcgggagttcgagaccagcctgaccaacatggagaagacccatctctaccaaaaatacaaaattagccaggtgtgatggtgcatacttttaatcccagctacttgggaggctgagggaggagaattgcttgaacccgggaggcggaggttgcggtgagctgagattgcaccattgcactccagcctgggcaacaagggcaaaactccatctcaaaaataaataaataaataaataaattttaaatttaaaaaagaaaaggaaagaaattagctgggcatgatggcacgtgtctgtagtctcagctatttgggaggctgaggtgggaggatgacttgagcccaggaggtcgtggctgcagaaattacagcataaattaactctccattagttaacttaatcaaagccaaaagttagctaaaatctttaaccttcctccaagacaacttttcattccagatatcctttcccaatttattgtaatgataagtattttaattttatcttgtttataaaaatttttattaatcaatgaaaaataaagctacctattatacagacaatctctaaaactgagtaactgaccccaataaaggtttatttctcactcgtatcatagcctaatgcaagccagacagctctaggtgggactccaagaagtgactttgccatgcctgaaggaggccaatataacttcaaagtttgcctcctgcttgtgggaaaatggaaagccaaggtttgttttaaggtttaaacagtgaaaggctttttcagtcagggattttgatttatttcacaatacaattacttcaaaaacttagatggcttcagacctctcattgccacacaaagtgctttctttgacaaagttctcaattgttctttatttctttgctttcctttccccatgcctttctcttgcacaagaaacagtggctacaccattactacaagctttgctaagagttgtttcatttaattggaaaatttaactagtcttcaacatttgaagacttaatcccattgctcactgcctggaatctagaagcagtacagttccctaaatcgtcaaggctctaaacttctggattatattttcttttattcttataaaccagctaaatctttcctgagctaatctctttcttgtactgtcttgaccaacatagccaattacaactgacccacaatactaaggtttaataaacccttcccctagggttgctggttcatgaggctcgtgctctgcctcaaaatttttgccagcaatatttttgtcactgaataacatagattgacattccaagccttctcctatcagcttccttgttgcccaccacatgatcattaagccagtgccacatagttgatgcttttgaaaaggcaataccttttttcaatgaagcaatttctccattactcaagataagtacaactagctgcagtgataccctctaaatctgtgagttaacataatagagatgtatgtctcacagcacattcagtgcttgttgggaagctctcctgggagtgtctacttcaagtagcgcctcaaggatctaggattatcccatatcgtgatgtcaccatcttcagttagtgacctttatggtgaacatgaaagggaaagaaaaagttcagggggtttaaggctatgcctaaaagtcatgtatattacttctgtctccatctccattccaccagacagaacccactaacatgaccccaactatttgcaagcaaaactggaaaacagtcttccgttgtgtctgggaggagaaaagtgaatggagactatatgaccagtctcttccacatctcacaagacattgttgttgtgtccactcaatgtttatttagattcactctcatgcttagcactttcttgctctttatacctttgttatagagccagtgggggctcactgcccaatgctctagaagccaatactatgactttggaagccaagacgaggacaccaggcttttgagaaaagaaaagcttaatactgcaagctggctggcaagaagacaggaggtcaagctcagatctgtctccctgtgctgtcttcaaggcagtatttttattagaaaatgtttagtgggtggataccgggatttgcaggtgattggtggaaggaaaggggaggtttggagagtccatgggcctgcacagttatctcttcatgcttactcatgggttgcatatgcaaatctggggggagttagtatgcaatatgaagtggaaattcagtccatgacgtcagcaagctcattctgcacaaactccagtcggccatcctggttccaattgatttcagcctgttttttcatcatcacacaaggggagggagtttcagtgtctcagcaagttgtttctttacctatctgctatcctaaaaactcaagaatttttgtaagttactgatttcttactctttggaacacagtttgagtttcagattttcagtgagttatttcttatctggtatcctgtaagcctaaaaatttagttattgatttcttcaaccctttggagcacagtttcacattcttgtatattacacattacatattacttctgggatcactttctatctacctgaagtacctcctttagaatttcttttagtaagtgccttctggccataacctctttgtttatctgaaatttgctcttcagtttgcccgtgtctttgagagacatttcttatgaatgtaaaattctagttgatactttatcttccttcagtgaagatagtattccaacaattagcctccattgttgctaatgagcagtcagctttcaatttaactgttattccttcctttctggatgctttttaaatcttctatccatctttggtgttctgcagtttcactgtaatatgtctaggtgtggacttctttccatttataatgcttaagatatactgacttcttgaatctttagttttgtaattttcttcaattctggaaagttcccagacatgatgtgggcagtcatagcctccacgccattctattttttctccttctggactttggttagatagatgttaaactctctcattctatcctctatgtctcttacactattttgttatttttcatcttatgtctctctaggttacattctgaataatttattctgatatatcctcagttcactaattctctcccaaactgtgtcaaatctgatgcaaaccttcttcataatatttttaattttaagtattatatttttcatttctaagagtgtatttttcacaacttgttattgttatctatagtttttttattctctgcacatagtttcaagttattattttatttctttaacatattatatctaattatactgttatctctgactaataattctatcatctgaagaaatggaatgactatttccacatctgtggtttcttcaagatctcattcactcttgatgactcattccttctgtttttgtttgtttttttactgcaactcttaaacaatttttgagggaatagtttgaaacctgagataaaggcaggttcctccagaggtatttgcatttaattctgcagagcactttgtagaattgctctaaattaaattctcaacttaaaatacctaggtagtgtgaattccagataaaatcctatatgagcaccactttgttgtttcaaatgctcagcgtcaattttcctcctgtagctggtacctaacaccagccattcaattttccttgcattctcctgggattgtttgtggttcatccttacatgaagggtatagctctttgggatctagtcttaaagcagggagaaattcctgctaggcttacaaccttcggcaggccatggactacgtttcctgctccccatactagttactaatgctcagtttttatttgtgtttatcagctgcctctgtgaccagtccacagagttgttgttttaagctctgcttcccatatgaggagagtaacttccagattgggtgtaaggtgaacgtggacccgctctcccccatcacataaagaggtgcatacagcacttactgtataacaggattaaacctcctcccgtgggatttactcacggatatgggtgataaaattgtagctacactgttgtgttcagcattgcatcctagcacctaagccacagcctggctcttagtaggtgctccataaacacaccttgactgacagactgacagttgagctcagattttttttcctgacaaattagagaaccatacaaatatattttaaaacacatacatttttatgcttgatgattttgctgtcttgtgggacttagcatatttgagtttacagtgaagacttttgagacttcatcttttctcagtaactaaaccattggttccatgagagcaagagcccacacacctctcttcatacacctcataggctagcacactgccatgcacctgcacggctggagttctggggggtaggttcgttggtcaattaaatcaacttatgaatgctgagtccatgaaatcatggacatttgcagtttcaaagctggtgggagcaacagatgttgtccactgccccaagatgagaaatgccctaagagatgttttgccaatacctatcgaatgcagtgggtcatcccctacccgaaggaggctggtctctcttcagtcataaataagcttgttctcacttatttgtgagccccatcacacccaccccacctccacagaagaggcccatattcaggagggatcaggcctgtggctatagaacagagtacagatcgcaaggccaccaccccagtagaagaccctgactcagccacagtcaatgaagcacattgatacttatgaaccatagaaggcagatcatatttttgagtaatttatagcataggaagaaaggtctccaaaagcagtgtccagaaaacgccctggtttaatgggatgagaggccttgtgtttttcccagatctttggtttccaggcaaaactttagatgaaaggtaatgagcacagctaccaaaacctgacggtctctgtttctctgcagctgcgcgtattcaagctggccaaatcctggcccaccttaaacacactcatcaagatcatcggaaactcagtgggggcactggggaacctcaccatcatcctggccatcattgtctttgtctttgctctggttggcaagcagctcctaggggaaaactaccgtaacaaccgaaaaaatatctccgcgccccatgaagactggccccgctggcacatgcacgacttcttccactctttcctcattgtcttccgtatcctctgtggagagtggattgagaacatgtgggcctgcatggaagttggccaaaaatccatatgcctcatccttttcttgacggtgatggtgctagggaacctggtggtgagtggtgaaccctgctgggggcactgtctcctggggaaaggagaaggcttctgggttatctgaaaaagctttgatctgcatttttatgcccagattgtacttctctggttgaaaagtcttcaaacttttcaaattcatgtgggattcattacaagaagtgtgccttgggaggcagtctgacttgcaggaatgagaacatatgattagaaaagaaagacctggtgtagaatctctgctccaccatttactaggtgggtgaccccaggcaagagacttaatctcctcaagatctaatttccttaaaatcaagaaaataatgcttactcatgggtttactgggagaattaaatgacaggagatgacatatgcaaattgcctaatgcaatgtctgggctgaggcaggaactcaataaacggtgtctattagctgttaaaggaaaaatgtccttccccaatctgagggggctcagaaaacatttttattcagggaagtaagagctgactgatttctccaagctgcacaggtcctagctgggagcagggggagaggctgcagggagggggcacaatgggtcacggacaacatccaaggccacagaaataataacaaaatctactccatgtttggaggaagcccctctggagactcacttgccaataagccccaataccccttctccgccccagcctggccccctgccctcagcttgtctccacccactctggtcatggtggggtccttgccctcctgggactgactggttgtgtgggaggatgcagtcttccagaagcccctttcttattgccctggacatcaaccaacttgggttctttcctcatgagttttatagacagaagaaagctaaaccaagaaaagggaagcaacaacaaatccagactctttagtcttttccaccctggtgcctgagccagggatgcctctgcctgcatcccagaaactctgttcttccaggctgagcccaccatccctgcagagccacagatgcccctcaccctcagacaggaagtttacccctctgagcacttttacatttctcatatcattttgtcttcacaaccgctcttcatctgctctcaagtgaagaactggaagcagcaagatgtgcccaggattccagagtcaggaacagagcccagggctttggcacatgagggtggttgcaggaagggctggtgccttctctctgttgtccctaaatgtccctctgctcagcggggggctcctcctttatggtggaaaatatgcttccaagcctcgtccactgaggcgggtcactccaggacatccccaaactttccctcaactgctctcagaaagtccattcccccaaaagggacagcatcccgggtgggcaggaagaggcccaggccgtggctgtcttgccagccagctgctaacccggtaggccaatgtggggctcagcttagagattgatcaatcttcccttccattccttctcttcaggtgcttaacctgttcatcgccctgctattgaactctttcagtgctgacaacctcacagccccggaggacgatggggaggtgaacaacctgcaggtggccctggcacggatccaggtctttggccatcgtaccaaacaggctctttgcagcttcttcagcaggtcctgcccattcccccagcccaaggcagagcctgagctggtggtgaaactcccactctccagctccaaggctgagaaccacattgctgccaacactgccagggggagctctggagggctccaagctcccagaggccccagggatgagcacagtgacttcatcgctaatccgactgtgtgggtctctgtgcccattgctgagggtgaatctgatcttgatgacttggaggatgatggtggggaagatgctcagagcttccagcaggaagtgatccccaaaggacaggtaagagttatccccaagggacagccacaggcagtggggaggggcttcagggcttgagtgacaaagggcaaaagggaaatgcagaggagaccttgacataaagaagtttaaaccatgccaagctttccagaggagttggcgtttgagcagggcctggaagaaaaagtcagaattccccaggcagacaaacagggagtggggggcagcaggtgagcaaaaggccaccttgaggtgcttggggattgtctttcacacagctgtcccatgcgctctgcccaacccaggctctgtgcatgagatgctaatgagatttctctaagaacaggatgttgtccaagagcaaggctcatctaatctttaccagcatcctaagaagtcctgattcttatgtgactcatttagccagcttttccccacaagtggtatcacagggaaatgacacgctccttttggcaccaactaatttaaagcacatttgagccatttgataatatatatttttaaatacttggcactattccttactaccttaagctggtatatcaaccctcgctaacctcttctcagtaactcagggcattcacctctgcccaacgtgggaaggcagggaaccctgtgaggcctcaggaacatgcagggctgctggccaggttactaagtggtccagaaaagctgtgctttgagtctgtagctctcccatagccttcttccctgcagtcgtcacttgtgttccagcagctgctgttatcagctgccatattttacatgcctttgtctaggtaacagcagagagcatgaactctgtgacagctgtctgccactcagaagcattttcagttactttggggctcttagggagctccaggtggccaagttccctacaattttgacctctggacaaataacaatggtcatggctaaaatctattgagccaagcacttcgtgcaaagtgttttacaagcgctaacatatttagtcatcaaaacagctgaatgatgcagatctagccttttcaattttgaagctgggaaaaatgaagattagagaggttaaacaacttgcctaaggtcacacatcttataattaatggagcccaaggataaaacataggtctatctagctatagtcttcatgctcacttcacacacgtgtatgtatatatgtatgtacatgagttgcatatatgaaactcttggctctggcagcctgtgatgtgcaagatcccttcaaatttagaactggtcatctaagggtggggccaggcacccagttgggaccctctctcactagcaggagcagctgcagcaagtcgagaggtgtggggaccacctgacacccaggagcccaggcactggaacatcttctgaggacctggctccatccctgggtgagacgtggaaagatgagtctgttcctcaggtccctgctgaggtaggtatgtcagcttcctggagaggttggacagccagccagacactgagcagtgggctggtagaggctggagggtggcggtgaaggtggggtattccagactgcactcaatcacataacctcatttcttatcctgggaatttttaaagtccctcccaacctccggctaatccgcacaatttcaactttcaccatataccattgccacaatctcactccagggtggttctaggtatagaaagaaagagtgagactccacaagctgtgggacctaagatcagttcccaaacctctctgagccgccatttattcatctatgaaactgaatggtaatgcctacttggtaggattattttgaagcttaaatgagatgctgcttgtcaaatgtttaggtcctgcctgagacaaagtaagtgcccaggaaatgacagccaagaaaaaaggaaacgaaagacaacgcacaaagaaagtcaaatatctttcagagccagcaaataagagttggaggtgctcacagatgaagaagttttcccttgtgattctcccccactttcttttgtccacatcattttctctaggcaaaagtagcctggggctagggagaggctctctataggtgagtagtgaagtgacagcctcacagagactgagctggaagattagaggtttaggattgtcttatacaaggtaaaaataaatgtggtttcacttacaaatcttgaaggaaacaagctatagggaaagaggcatctataaaagtttagcatctttaataacactgccttcaattcaagaatttaatttgacacctagccactgagtgctgactttgtgacaggcactgggctcaacagagataaggaagtcataattcatccccaaagttatcaagcccttcagcttgaagaatgtcagctactggctgtgtgccctaggcaaggctgaccacagcagggtaagataagagggagggctgggacgggatttgggggctgtgggtgaacagaagccgcttggttcccactgggtgagggctgtcacattctgcacgtggatgtcatgcttcttcccaaatgttccaaggactcccctggctagttgtccctactcaatgttttcagtacacaacttctgggtgttggttttttgtttttgttttcttgtccatgaccccggctaggcaggaggggcctgacagcgacaaatggggacccgccccaccatttgggtccattagcaaagctatcaggtttactaatatgagagcaacttcaacccctaattgaattcatctggagacattatagggctggagctgccaggagggcagcaggcccctgcagcattactccatgattaaatattcaagcccagtgaatgctgagagtcgttatgggtgtaattacggtgtctcgggccattgccagcactccatcaggggccccgaaggtttacagtctcacacagctaagcctctggggctccagggagaagagcagtgttccaggcctcagctggcgaggcaccaaacatgggtgcagttgaacctgcagtgaccgtgtgcaattccccgggccccgcggagagacgagttcactgccctgggcttctcccctgcagggagtggacgacacaagctcctctgagggcagcacggtggactgcctagatcctgaggaaatcctgaggaagatccctgagctggcagatgacctggaagaaccagatgactgcttcacagaaggtgaagggacagccacaggccccctcacactgatgttaattagggccagaatccagttgagcgaacactcacctgggatccacagaagacaaacaagctgtgcccacttgctgcctcactcccaggcttgagggcgcccgcatcagacacacatgccccaggtggcagcagcctggccgtggtatctgcatctcatgccctatcagacactacggagagacgtgggccttcctctttaccctcaaaaacccctccgtgagttctaaaccagccctcttgagttgaaagggggaaacgtagtcaccaccataaacaccactgaaaactcttgatttggaccatgaaggacccagaggaaggccatgatgtatctgcttccctcaatcttttgtttagctctcaaaagcagaacctgtgtcttagtcatctttcctctcagtgtttagaacagtgaggcacattacattctcaataaatatttgtgcaatgaatgaatcaagagtccattctataaagggaattgtggcctcaatgctttctaaaaatacaaagaaaaattttttaaatacttgagtttttattaatagttttatttgaccctgggctgggctgagctgggctggacccaatccccatcccagccacgtcgtggccctcagttcagcttgggcttggagcatatccccctcaggcacccccaggctcatacgccgtagcttgtctgttttccaggtataggtgggcagaaggacagggaccactggtgtcatctgtaagaaggatatggctaggaaaaacatcagagtgggcaagactgatgatggagaggaacacctgttggtctggattgagggactccctggaagggacccctcttcacccatattccaggaaagaatttttttccaagggcatgacaagtgggtttcctagcagaatggtttctctgcagcaggagcagaaattatcccctttgcccactggccatcacccaccatcagtcacctctccccacaggatgcattcgccactgtccctgctgcaaactggataccaccaagagtccatgggatgtgggctggcaggtgcgcaagacttgctaccgtatcgtggagcacagctggtttgagagcttcatcatcttcatgatcctgctcagcagtggatctctggtaaggggaggcatagtccctgcccccaaatcctccagataggaatctcctacaatccaaaggccctggagctgcatcagtgggttctcctgactactgagctgaaagtccccaaccttgtcactagaaggagagctgcagcccagggcgagggcccctcttagcagcagagcatgggaggtgttcaaggtgcccgtgccatggcctgccaaacctggctgcaagcatttgagtgagtgagtgtatgcctcccactatatagatggggaaactgacactcaaaatgtttaaaaggcttgtccaaggtcacccaacttgtcagtagcaaaacccagctttgcccttatttaatcccgaagcccctggcttcccaccctctgacctccccaacacacggccttctctgaaggcctacaatacaaaaaggactatctttccttatcaaaccacttccaaatgctactaattactcctttaaagctcacagaaaatcattacaatagcacttctcaaaatttaatctcccaggagcttgttcaaatgcagattctcattccataaatctgtggcagggcctgagaatttgcatttctaacaagctcccaggtgatgcttgcactgccctcagtgacccacactttgaataacaaggccttatgggaatagagattcagagttgggagacatctctaaggccctggctgaatactgggctttgtagagcaaagaaggaaggttctctctgtactgtggcttaagctccttacacaatctcaactactccgccaatagaccaaggtagacatagacacaggaaggaacttaacatcctcagttgtttgcattttctaaatgaggaagtcaaagcccaaaggcatgaggggcttcaggtaattagttgaagggctgggaatagagagttcagggtggcagctaattagttgaagggctaggactacagtcccgctcttccgattcacggctgcagtgttttcactcatcttgcgcctcatgtgtcatttactctctaaaaacaacctactaaatatctaggcctccatctaaatgccagattgtccaggaagggtgacaaaactgctcggtgcatggcctcagctttagggaggagcacaggtgcgggacgaggcaggatctgagaggtgggaggaaaactagggtggcaatgacgcaaagccaagggagaagagagtttcggggcagggactggtctgccatcctgggtggagggggaactgtgtgacagcggctgcaggtgcccagtgccctggcacagggcagtgattgtccacacggacctcagcacagtgtagaggccaaattgcaggggcaagagagggctgggcagtgctttctccacacctatgctcttctccttccagtcctgctggattaaagtaataaccacatgtgctgttggccaggtgctctcctcactacgtcattggcttgtgggccttctctcctcattttgcttctctgctctcccttgctccctcccttctctctctagcccccttctcttcacaccccggtccaccccccacattcccaggaggaagctcagacctgcagcactgcgccagcccagcccgccccctgcagctctcccttccctcccatctccttcccctgggactgaacaggctggcaccaaatttagccttctttaggctttcactttgagtaccttttaaaaataacatgcattttcatctgacaaagtaaagtaccaaaaaaatacttggaaattatagaaaaaggtaaagaaaaaaaaatcatccatttccctatcactcaaagagaaactcacttgaaaacatgctggtatacctctttctcatcttgcttatgcataaaatatacacatattacaaaaataaaaccacatttatgcattctataacctcagtacatttttctcagtaaatagtctcatattatctcatttaatggctataacatattcctttataatttactcaaccaatctctatgtttacttctaatacacattgaatattccctgtgtgtactcccttagagacgttggataatctcccatcttagtcctcgtcctagacacagaatcggaagctgagaaaagatgtgggttcagttgaaatccggcttcagctgatcccatggaaagccctgaagcacaaaggacaccaaagagctgtcccaccttgaggcaaagaagacagccttgtaaatccccctgtcactgtccctggctgagggctgccccagcggggaggataagcatttcccaaggtggacacagtttcctccagcccagcgaagccatcaggaagggggtgtctgcatccatgaactattagcagccgacactcccagcagatgaaggataggggcactggccccttaaagaggacctgagtgggcaccaacagcctccagtgtccttaggattagtgcttgaaggaggaattgctaggttcctgaaacctctgagtcacattgccaatttggcttcacacaggactggccaggttttcactcctgccagtcacttgtaagagtggccgggcgcggtggctcacgcctgtaatcccagcactttgggaggctgaggcgggcggatcatgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacctgggaggcagagcttgcagtgagccgagatcccgctactgcactccagcctgggcgacagagcgagactccgtctcaaaaaaaaaaaaaaaaaaaaaaaaaaaaaaaaaaaaaaaaaaaagagtggcagccccccacagccacagcatcctagggtttcccctattcttttccatctccaccagtctgataaaagaaaaacagcatcttcttttaatttgaatttccttgattaccagtgagatagaacattctttttcagaggtgtgttggcgattcttactttcatttttgtaaactgcctgtgaacatccgttgatgcttttatttttaaacaaagtcactgttagcatccctttggttcacttccaaaatccaatttgagaaggttttctttctcccttgcattcagcatccctgcaagtatcagcagggctgtttgtccccattggccctgaagaagtcatgctttggatctcacagtacctcctccactatcccactttacctccccacagcaaacaaaatgctactggcaagctgactaccaaatccccttccagggactgtggtcagggctggctgggtccttccctatcagtctgggccccagtgctgtgggtccaggcagcctgccattctgcatcctttcttccttccaggcctttgaagactattacctggaccagaagcccacggtgaaagctttgctggagtacactgacagggtcttcacctttatctttgtgttcgagatgctgcttaagtgggtggcctatggcttcaaaaagtacttcaccaatgcctggtgctggctggacttcctcattgtgaatgtgagtggctcagtgggaacacgtggggtttggggtcctcccctctgactcctggctacagctagggcaaaggaagctcagagacctggccctcaagggctactccaaagaaaagttttgagcatttagtgaggagtctgagaatagccctgacacccatgagtggtaaagtccaggcagtatgtgactgtgacacaatagtgactgttaggtgagttattaggtctccattcagaaagatccctgcaatcctctgcatttttacatccaaagtgagatgacacatgcagctctcagaggtcttatggccctgcatccatagatgggtcttctggaccttggggagccatgaactgtgagcacagagaatcttcccacctgcggttctgtggtcctcacacctggctgcacttgagaatcacctggggagctatgaaatatgcagtgaccgaccaccactaccccagagattctgatcttattggtcttgggtggtgcccaggcacctgtattttataaatgctcccaggcatttccaaggtgcagccatggcttagaaccactgagcttatactgctgcctcctccccagtggcattgaaaagaacagagggcgcatttggagaggtaatgagctggagttcatgtgttcacactcatggtaacctgtggccagtaatccctgcattagagaattgactgtgtgcttctcacacatcagacatgtgattcctcagtcatctcttcctcatcttaaccaccacattgcactatcactgtctaggccactaccttctttgctttgcagcatggttaactgagttatctgttcactgccgcatagctgagggtttctgcaagcagggtgaggcatgtgctgtgttggtctctgcctgccccactcaagcagctgccagcagcaaggtctgcccagcagaggtgtcaggaaatgtgtctgtatttggtgcttgcctcctgaagctggatgaggttcagcacagaacattctgtccagcctcctgtgctggcaggtcctccatagcaggcctgtgcattcaattctcttcttccctgatgccaatgcactagcagcttcaggccactgtaccacaaggattagctgtgaggcctgaaatctgagtcatgggtgataattctgtgcatatgaaataattattcataaatgaaaggaaaattatttattccggtgtcccacccctttgggggcacagtcactcctgcttatgttgatctcaccagtctcagtcctaatcaccttaaacggtcatgcactcatttcatccatcttcctactgattcttccttccaaccatccatccttccttccatacatttcaccttttgtatccaaccattcagtcttcctttttccttcctcccaaacatccatccatctttatttcttccagctgtacatcttcatcagtcctccccttccatccatccattcccattcttctttccctcttctcttctgcccaatcttttattctaaacttccttccatctattcatcatccttaacccttatatctttctatcttttgattcattcttctatccaactgtccaatcatctaacattctgttcactcattcacgcatcttccatccaagcatgcttctactcactcatccttctatccactcattcttctatctttccattcttgtttcaacctatccatctattcttcctttcttccacttatctgttcattcatccctttcccttccattcatcatccattcatccatcctatcaaccttccagtcattcactaatttattccattcatctattctgtccagctccccatctttccattcatgcattagtcattttacccagccatccatccttctcttatccacctatctcatctatccattcactattccctgctttcatacttttcctttcttgtttgtttctcccatccttccattcaactatctatcctatccatctttttgtgtctgttatcttttaaaattttaaaaaatatattttattgtatatatttgtattagtctattttcatgctgctgataaagacatacctaagactgggcaatttataaaagaaagaggtttaattggacttacagcttcacatggctggggaagccttacaatcatggcaaaaggaaaggaggtgcgagtcacgtcttatgtggatggcagcaggcaaagagagaggttgggcagggaaactcccccttataataccgtcacatctcatgaaacttattcactatcatgagaacagcatgggaaagacctgctcccatgattcacttacctcccacagggtccctcccctcccacaacacatgggaattcaagataagatttgggtggggacacagccaaaccatatcaatttttaagggatacaaaatgatgttataagatatatatatatataaatgattactatagtggaacatattaacatatccatcatctcacatagttacccatttctccccctgtggcaagagcagctataattactcagcgagcaaaaatactgaaaacaatatgctattattaactatagtattcatgttatacattaaatctatcctatttatcattgtatcctttaattcatccctctatgcaatcacccttcaacttttcatccagctgtacttctttctttctttccttctagccatcccaatgatcctatttttcttccatttgctatacatctaactattgaatacaggattgtcttatgaagtgctttgtaagaaacagaagcacagaataaatactcactatctccaggatcttacactttagtctttcagcagacaagacacacatggaaataaatgtattataagggtgaatgtgttgagcactgctgggggcaattagtatcttggagacacagagacatgagccttcttccactcttggggtggggtggttgagaattcttcctatgggaggtggcattagatgtggggcatagaaatgagcaggaccaaggagctgcgagaggactggggaaggcccgtcttagctaaaggctgaccttgaacaaaggcacagacacaagtatgctcagggaacaatttgatttgggtagaatgtgtgggtgaaatatgactggaaaagtaggttgtgaccatatgacacaggctacagagtatggagtttatcctgagggtgataaagtaccagtgatgtttgggagtaagagaaagacatgatcataatcagatttgcagtggagaatagatgcatggtgcagtactagggcctggagactacttgggaggctagtgggctgagcagtgggaatggaggtgggcttgggtggacagactttgctggagaggcacagcacctgtctgccccagctgcagattatccatgtgaggcagacttcccagggggctgagcaaaagactgaatagggttcagcatggaactggccccaaacctccctaccctcatgcacccaggcagctgggtctcacctgctgatgtctggagccttgcatgaatgaaggaagagggtcccttccattccggttctttgtcctggtgcaataagccactcatccaaagaatggacattgcttggggctctgccactcaagtataaagcccttcttttctgaagctcctgtgtgcatcccacctaactgccaggataagctgagcctgaattcagcccaccatctgtggtgtggctaagatctcacaggacagggtcatagcccgtatctatgacatctccctggcaccttcaaagttcctagcaggggaacttttttcatgtaagtttctgtcctttgcagtctttggaccaccacttaaagaaaactgacagaccaaaaggggctcacaagtcagtcattatatctcagatatctattgaagctagatctcatggacccataccagaaactttttgaagaactgcagagctatcagaactttggaattctcttagtctgactttttcattttacaaagggtgaaagtaccctggactagccaggcactaacccaagctcacaaaaaatcagggttcaaatgggaattagaccccacccaaaccactattctttccaccccacttctctgagcaaatataattcagattactatattcctcagaatagactctcagcatagcccctaggagggaacatcatgtctccaagtctctgaaaatcagtttcaaggttgttgaggcctgactgctgcccctagaaggaaaaggaagagttgatttaatacactggaagcttggccacctacgtaccagaggttggtgatgttagagactgagtttttcttgcccagattgtttaagagagtggtgaataaaatttttaataaaagggaagagacaaaactctttctagacctctcattggagttccgaataaggtgggagctaggatgatggcttagacgtgtaggaatgggaggctgggcagggagttcctgtctccttccacgaggactgcctttctggaaacctagagtgatgtttctgccctctcctgcactcagatctcactgataagtctcacagcgaagattctggaatattctgaagtggctcccatcaaagcccttcgaacccttcgcgctctgcggccactgcgggctctttctcgatttgaaggcatgcgggtaagtctgatctcaaaacttctctcatctggccaggcacggtggttcatgcctgtaatcccagcactttgggaggctgaggcgggcggatcacctgaggttaggagttcaaaaccaccctggccaacatgccgaaaccctgtctctgctaaaagtacaaaaatcactaccaccacgaggtgtggtggtagtgagccgagattgtgccattatactccagcctgggtgacagagcgagactccgcctcaaaaaacaaacaaaaaacttctctggtctgcaggttttggtaacccttccccctttatgccctccatcccaccaaccctgagctccggggccccacctccaaaggtaggctctgagtcttcacttcctgctctgactttggtggtgctgcatgtcctaactctcttagttctctttcaagtctttttgtgggcccatcttcccttgtcacccataaatattacagccaccaggacccagacctcaccccctttgctcttagtgaagtaatcctgaatcatcgctccacaagcatctattatctcaatcacccaactctgcctcttattgccaacatctccagaacatcccaagttctctgtctttccatgacaaatgagtctttcctctaatactccatgagtgacatcatcagctcattacctcagctgccacccactggaatgcttcttctctcctacttaatgcaatcatcaggtcctgtaaatttttcccttccatccacccctttccttatccaccactgtcagcctccaccttgccctaactgcctccgtcaggacagaatgctcacagccagagccttgtcttagagattgctgattgacacccacctcttcctcataattacaaatggctccccagcagaaagtaaggttttgctttgctccactatcattggctggaagtagtcatcatagcttcaaaaacaaaagtgggcttttgaaattaacttgtacctttacaaacactaggacccgaagattgaaatagtttgaaatttattctattttgtatctaatagattctcatttgcttatttacaaataagctattttgtgaatatggatttaggttttcactggttcttgaccacggcatactttaaattgtatttaaattgtgtttgtgttttatgtatggtatttaaggagaataagtcaaggttctagaagtctgtatgtgcaagtataatacacacactcacacttctaaatgagtgcagtatgcttgtaaactcatccatcttctcactgcaacccaccctgaatgaggttaagggaagaaggtctaaatccatcttcagctgcccaatgtctctcagtcttctgagtctgaattattgcactaattaacccacttctcttgcttcttccaaaggccactggctcatgaagcagcctgaatgagtatagaaagagatagaatccagcagagggggtggggcattgggaggttccaggtctttctctatctcccaccaggtggtggtggatgccctggtgggcgccatcccatccatcatgaatgtcctcctcgtctgcctcatcttctggctcatcttcagcatcatgggtgtgaacctcttcgcagggaagttttggaggtgcatcaactataccgatggagagttttcccttgtacctttgtcgattgtgaataacaagtctgactgcaagattcaaaactccactggcagcttcttctgggtcaatgtgaaagtcaactttgataatgttgcaatgggttaccttgcacttctgcaggtggtgagtcaaccatgagatcaaccatatctcttgctttggccgctcaataaaatggagagtctaggttcccagaagatgctatgtggggactttgcaaggagtagcactcagtgtgaactgaggtcattctctattcctacagactacaccatgaggctagagggccttcctagtgaatatgatatcacagtggtgcaattacacaagtgtgggctagtagaatagcataaagggatgggcctgccatgggattatcaggtggtgagttaaaacacagaacctgtacaaaatagacacggcatagccacatgttcagtcttcaacttcacatcatttcctaaatggtaataaattatgtctcattaggtctattgtaatgatatataatgttggtgataatgacagtcaaacacattcatcctgtctttctttctttcatcatccagtcaatcactcatttcttgccttcatctacctgttcattcagtcctctgttcattcaagtgttaatacaattacttatacatttgtcatgcagttactcttgagtgtctacattccaccattggttcttgcatttattcaacaaataatctctgagtagctctggtatgccaggcatggtactactcagccctgggagatacagtcagaactgggcttggacactgatgctgtatgagaaacagactaataggtgaattaaaacagctcattaagtgctgtaacaggcctaggagtgtaagaactaagatgtcttgcatgctctgaacatgctggaaggcacacccagtttctagacctcaagaatgctaaagctgaaggcaggaacatggaggtcttctattctcaacttctccatctggaagatataccattcttacatcatgtgcataaggtgggaaagtggctgagaaaatggcagccctgagaggggaaaccttaggcaagtgcacagagcagacttgtagcaattggcactagaaccagacacctagacactcagtcctcagtccatactacattctgaaaggctctgtgtctttaatgctactctattcttaaacagccacatgtgggattactttaaatcatcatatgagattagtcaagtaacccaagggaacttttcctttcattctttctgcacaagccctttccaacacaggactctctcctctctcactgggccaccatggcttgggaagggtccagtatagatggatgggcagacactgagtggcctctgctccttgtctccaggcaacctttaaaggctggatggacattatgtatgcagctgttgattcccgggaggtgagtctcagcccactgtccctacagccttcccctctgtgcattctacccatatcagtctgcatttgaaatgaagtgacgatgaccctggtactggaagaggcgatcacccagcaacctcacactgtccctccttgcagcagtgtccagctggctctctgttgagtgtttcagccaccgaggctttccccctttcatctacactccccaggcttctcgaggttttcctctgttcactgttgaggaaagcatcagataacctctaagagacagttcatgtgagccactccctggacaagggtgggagcaaagcaagggtagtagctaaatcaaggtgcatagggaggaatgaggtagaatctcaggaactatcataaaacccaggatgggccaggcgcagtggttcatgcctgtaatcctagcactttgggaggccgaggtgggcagattgcctgagctcaggagaccagcctgggcaatacggtgaaaccccatctctactaaaatatgaaagaaattagcagggcatggcggcttgtgcctgtagtcccagctgctcgggagactgagacaggagaatctcttgaacccgggaggcagaagttgcagtgagctgagattgcgtcactgcactccagcttgggcgagacagcgagactcaatctcaaaaaaaaagaaaagaaaagaaaaagccaggctggggagacactattggggaatgaccacttcctgctgtggcaggcactgtcaattccctgccacctcttcccttagcccacttctgatttcacctgcaggctgcacttctgattctctgtataaagactccagggcttaggagcttgtgcagcaacttctcccccaagtaccagggatttaatgtccctaggggcaacccttaccaataagttttgggagtctgaggataaatactccagtttccctgtcccttggtgatataatcctgcatgtgctctacacagttactcagaggaccccagtaggattgcgcttcagttgcccacaatgatgccctgcttaacaacatcctcttcacaggctcttctcccattcccgcttattcttccccactccctcattcctgcttccttggatcacctcccagataaatcacctgcacccaggtccatgtcttaggcttggctttcagagtgaacctgaactaagacacccaccctccttcccactctcccttgtctggtcacaggtcaacatgcaacccaagtgggaggacaacgtgtacatgtatttgtactttgtcatcttcatcatttttggaggcttcttcacactgaatctctttgttggggtcataattgacaacttcaatcaacagaaaaaaaagataagtggtgctcaggagtttctggtttctgctgtagtggtaagccttatatttcctgttccctgcccagctctggcctcctgacaaaagccaacactactcacagcccatcactttaatatcagtgctaacccttgccctgtgattgctgttgcaggaagagttgcatttctctctgtcagcaatgccccactaacatcctcactcaggattcacatctcaaagggatcttggtcttcccaactggaaccaggtgtgttagatgtgttccaagtgagccctgggagaatacaagcagggaaagaaagggatctagaacttgctgacctgttgggggatatgatccccacaaaggactgagtcagggcacctcaggaaaggccatggcccagcactggcagaatcccaaccctccttgggatggggaggaaggcttgtgcctccaagggtgccgactctgattaataggaatcgaatcccagataacctctcatgtttataagaaaatgtcagggcaataaaggtataaagtattttcctattatcctttcatttaatgccttccatacccctgaggtagataggcgctgttctagatttgcgtaactgagatcccgagagaaaaggggctacatggataagtcacagagtacatgcaaacctgggtttgcattcctgactcaactacttgtggatggctcatgctggcaatattttaaacccctctgagtctcagttttctcattcattcaatggggctaataatacctactctctggattgtggtgaggggtaaacaaaatcctgaacaaagatcactgagcataagacaactttggtggtgcagtttctggcactgtaacagcagaggggagtgtgactggcagcgcctcaagagcaccagatgctgttgctattaacaatttaaaatatatacctactagggcaggcattccacttacaggaaatccttgcccagggttctgagcataagaagaggacaggataggtctgggacaagacagtgctatttagtaccctggggaggtttgagattattgaagcaatcatttctctcattttacagatgagaaaactgaggtcaagaaacagattacagagggagatattaggtaacggaaggagatgagctagtgaccaggctggggtcactgagaaactgcatctactgaatccttggtcagagttctcagcatgacctcacctggagctcacctacccactgcccttgccctttccttctctccccccataaagatggtcctcccaggaagccctttgtgtccacagatcttctcagatctcctttcaaattccacagatctcagcccagtttcccagcatttgcagggactaacttacataaacatgttattaaaataggtggctttcaaattatgtcaggaagctaaaggtgagagtttgaatgaagaaaatccaaagggcccctaaagaaaaactaatacccaatcctaagggaggaaaacatcttcgttggtgcagtttctggcactgtaacagcagagggcagtgtgactggcagggcctcaagagaaccagaggtccctctgagaccaaggacccaaggataaggcagtaattgtcctcatctcctcctctccagaaaagatttgagggcttctgtccctcccagagtctttgcttcaaggtcctcaggaaatctcttgccccctgggagggactgtgactctagaagcccaaagaattttactggaatgaacaggctagatccaaggctcagatttgaaccaacatgtaccttctccttgagtcctgtttaccaaccctccccaccctttatccagcatctctggatccctggagaacagaaactggctttgctttagagacccaggcagggagtcagcaatggaactcagtcccaccgttccgacactggatgtggcaagacactccttgatgctgggcttggtttgtctatctgcagaggaggggagaaggttgatatgatcctttctctcctgcctgttctgattttggtatccgtagggggttcctcttgctttagtaacagtgtggccctctctgcacttagggggccaggacatcttcatgacagaggagcagaagaaatactacaatgccatgaagaagttgggctccaagaagccccagaagcccatcccacggcccctggtgagccccagaggtttcctctagcacagcctgtctgtgaatccaacatgacagtctatgcctgtgtcaggcaggggcctgagggagtgctgtttatggaagagaagatctgggttgacgttgggatgagggtgatgagggttcctaggcccaaggaatgagaagttcaaaagaagcaactctggtcttctggagtaaacataccttttacagctatttgaaatgaatctgttgggggaagcactgagtttctccaacagttttagagttcaagtacaggattggaggcaggttaagctaagtgacagtaagggtagttagaacccagggattaaacttgtgtggttatgtatcatggtctaggtcgcagtagatctccagtatcaccctatattctaccccacgcctacaggtatagagaggaaatgacaacaacccaactcccctgtcaggatccaagatgcagtcatggtagtggtcaagtggcccagtaggaaccaaaagttatcccactcgagtttaaagattgggcaaaaattagggccagactctagtttcactccttttttcataaagatctcaagagacatggctttgcgttcctccattaaatgtactacccataccacacatgatatcacctaagttcttctcagtcttctgccagaagatagaaaacatcaagcctctgagaggccctaagatagcacttttttgggaatggatgaacaggtttgggggtgaagatgttgatgtgtcagaaattattgttgatcgtcttcaaagaatttctgagccatccactccagtgaatggaattggccctgtgtccttctacataaactttctgtggctaagatgcagcattagtgaagaaaatcacaggtattgctgatgacacaatttcattagcccttccccacacaagggaaaagtccaaaggacatttaacaaaggaacaagcctttccctaaatgaattatggagacatgcattctgttagccaagctattagatttttttaaatcaaggtataggatttgcataatttacttcaaactttgtcagaacaaagtgaaaaacatttacaagagaaaaaagtgatgacttttgacactgtattttgaaatagtggtcatgaatttattactagtctagattctgataagaagtattacaatggggagtggggagtgataggaggttcagacctctgtaggggcacagctttcttcctaaatcacccatacaatcaagataactggatttgagtgaacctgagcaaaagtccttaggctcattgagtatccctccatcaacaagttcagtggagaggagcaggctcaaaattaaaattaggtgaaaggctgagtcccaaccacattcaagtcatgggtaatgagaggaggaccctaagacttactgagaagcaagcagctgagtccacactggcctttacttgtggctggagtaagattgaatccacatttgagccagatgccaaggaggtgtgtgctagggacaacccttggcaaaaacatgaaagtttttggcaccttcccccacatactactcaatctctctttgacatcccagcttcttccctgtcatcacccaaccccataggctgccaaagaaagcttcctcccctcaaggaagacaacattcttaggacaagataaatcatatttcaaaaagggaccctggagagggcatctacctacaaaggcatgaccctaatgttgaaattccaggcagtaaataggagtgggagacggagttgatggtcaggcaggaagacctgcaacaaaatcaccatttctcctaattaagctgcaactaagatcctccgaggatggcacagggggagacctccacatgtggaggggaagtgaaacctcataaccaattctgttcctgagattctccatcctttgaatggaagaagagtggattagtaattcactctcaaccttttgctagccttagtggaggaacgtggctctccccttaatattctggcccaagcaaggtaaacactctttcctttgttccctaatttcgcatagctgaggcaaggctagaacatttaaacaaaactttgaagtggcagggatgccaacagagaaatcagcacaaagcagagtccaagcagcacctgcagatggctgcactccaggacccataggtcttggaccatcctagctcctgaccagcatccaaatggcaggcaacatctttgacacccacatgcccagtggcacaagccggatcatcttccctcttcaaagtctagaaccaagaaagaaatccaaggcaaaaggaaattcccactcccaactaagacccttcttcccaggcccagcttgcttttggccagattattggccctggaatgtccaccttctccccttaggagccccaaaggtcaagctggtcataccagcaaagcactgacacaggatttctgccccatcagtgcatgggtgccatttcatgacagagcttacctgggaccacataggagcctcacacacctcctctcacctctgatgatgctcaggctctaaatcttgtttcttccataggaaaagttaaggattccacaagactgggaaattttattctttaacattccctgctacagaaatcaataaaagcagctctcacatactccactttatagaaatataataggctctagagaatatcacataatcaatcacccacttcatcgtctctgagagcaccaagggttgcaaaggtatgatccctgaccgtgggctaatccaagagcagctagcaagctactccattccctaaagtcagaatatccagggcaaacttcacacccagccacttaacgatgccgttgcctgctctgtttaattagaagtcatgtgaccatgaatgggcctgtattttttcaccattttcagtgatgaaatggaagggattagtggctcagcaatccccctcctgccccaggaaagatgtgagccagcagttctgccatgagcaaaggccactttggtctgattctttgctctaacccaacaggatagcaacccatccccaccatgaagcagaaggcaaggatcagcctcatcacagcacttccccctctgcttgctgtgcagctcccgtgggctccctggaagggatcagacaggttcttctcttcctccctcatagccactcatgcagaggcttgcacatcccatacattcagtatgtacccttggtacagaattgaatttagtcaaataaagggtgactttaaattttcatttgagctatggttaactcagagctgcccattctgtcttccattcatttacaaatttgcagagcatctgttgcagccaggcactatgcagacaccagggttagagcagtgagcaagacagacaaagttcctactcttacagtttacagtccagtgacagaggcaaacagttggccaaaagttgcacatatatgttaattcctggctggataaattgtcaagggagaaaaaatggggtgaagagcaaaggatgctcaagactgagcctcgaagaactctgatgtctaaaagttgggtaaaggagactataaaagagcatcacaaatggcaagaaaagaagcagaaatgtaaggcatggtggagaccaagaaagcaacatttcaaggtagaagggtactaggcaatatcagacaagcgtccttggatctaatattatgggaagtcattcatgatcttagtgagaacaatctctgtcaggatagaggcaaaagctctgttgatgtgggctgaggagtgaatgagggacactgattgtacacaactctttcaagaaattttgctttgaaggtgggaagagatctaagatggtagctggagggagatgtaagtttctgaaatattctgctttaagttaggagaaactaggtcattagagatttgtgcaataaaccaagagacaaagagtaatgcacatggacattaatgttgcctaggataatagccaagagtgggcaaatatggccaagagcctcacccatcattactgaggcagagggaccaagagtttggcaagcggcagtaatgaagaagtgacaaaactaggtggcaaagcttcaaagcaagaaggggttttacaagacacaggaagagcagtggtgtggaagggtcagtggtgaacaaggagaacgccaggcctaacccctgaggtacatggggtaggggagaatggcagcctttgaatagggggagatatgtgcagatcaaggcaggtgagctccatagaggtcaggagaagttttgggagaaggtcaaagcgtggggaatggggttgggatcaaggactcacagagcagtaagatgttcacagcactaaaagaagagaagatcacagtaggagctttttaaagacaccataaaaataaccagatataaatgatctcttggttatccaggccactctgcctccttccaagatgcaaacaaccaagacttgaccctacgccctatacctgcatttgcttaggcatttgcacagcaccaggaacagagggaacatttccaagaataagtttcccctttgcacttgactttactctcagcaaagtagctcaaattaatatttcaagcagctcttgaactcttgcaatgtgcagggcactgcagggaaacaaagttaaggaaggtatagcccttgtcctcaaacagctcattgtctagtagagaagacgcatatacaaaatgctagaactcgaggctgactgaaaagtgggatccccaaagggacagggtagtgtgttgtcacgtgactaagggacactccatgcagtaagtggagcttaaaagagatggattactcaagactgttggaatttagacagccaagagaggagataggagggcattgtgaatagaggcaagggcacagaccaggacaaaagaagggcctggtggcatcaaagggccaggagaggtattaaggacttgaactggggcaatgaggtagagtcaactaaaagtgaaattttggaagaggtaaggatagtatttcgcttctgttaagatgtggagtgtgatggagacaaaactcatctacagataacacagatgcctggtttgtgctggcccaaaggccctgatgccactatctcttgttttctcagaacaagttccagggttttgtctttgacatcgtgaccagacaagcttttgacatcaccatcatggtcctcatctgcctcaacatgatcaccatgatggtggagactgatgaccaaagtgaagaaaagacgaaaattctgggcaaaatcaaccagttctttgtggccgtcttcacaggcgaatgtgtcatgaagatgttcgctttgaggcagtactacttcacaaatggctggaatgtgtttgacttcattgtggtggttctctccattgcgagtaagtgggcagccacgtggtggggaagccccacctctgtttgggggtctttgggatgctcttctaaaaccaaggaaataaccaaccaactttttgaaatacgtgtttatgttagaagaaccctgtatttgcagctttccaagagtagcaagttttaaatgccttgggctgctctctcagtgaaatgaagaggttctcttggccttctccatgctcacacgaagtgttttcaggcacctactgtgtgcacagcccatggctagaacctcaggggctgacagggaataatcactcctcctgagaacctcagaccgtaagatgatggagtctccagcagaccttacttttatggtcttgaaagcagggggcaggtggtgtaatgtgagatgagtcttaaaatctgttctggaaaaggagatggattgccatcaaagtgaggaaagactgggaggagattgttcaaaggagattctcaagtctagggtctggaattaaatctctacacaactgttctattagggaacatgagtgatagaaaagtcaagatatcaatgccaagaaattaatactgttaaggcccagtctgggtgttgttgaatgacaggcccagtattttgggtccagtggtgttcagagaaaattactagagttagaggctaacatggggaaatggagctgccttgactgaatacttcctaagttctgagcactgagctgggctccatgaatgttcacagcagccctgtcaagcaggtgttattatccttattttatacatttaaaattgagactcagagatcaagaatattatgcagggtcacagagtttccaagggttgaagctgagtttagaacaggctccaatcttctaatgaacttgctgcctgtcaccaacagccaagagactgtccctgggcttatgggttagctgaagtttgaccctataaaggccaaatcatgctcaccagcttcacctggcattataaatgtatcttgattggttatatcctgacctgcttacttttcatgtcggggtgtagctgtagatttaatttgccactgatttagtaacaagagctgagagtatctaaatacaacttaacagcatttcatcaacctccccaccttggtgctgaaacacagccttgggttgcgtgtatttccggggatttcagtttgtttttgttcttgttttattttgatattgctgctctgttttttaacactttattgaggtatgatccacatgtaaaaagctatacatgtttaatgtacacaactttatgagtttggagataagtatacacccatgaaaccatcaccaccatcaatgccagaaacatgtccataacctccaaatatttcctcctgcctatttatttatttattgggtgctaggaacacttaagatttattctcttggcaaatttttaggtagacaacacggtattgctaactatagggactatgctataagtagagctctaggatttattcatgtcacataactggaagtttgtacactttgacaagtacctccccaatttcccctcctcccagctcctggaaaccaccattctattctctgctcccatgagtttgactattttagattccttatataaatgcaatcatgtcgtttttgtccttctgtgtctggcttatctcacttagcataataggagtttttgttggttggttggttagttgttttcatttttgttttgttttgtttgtcttccaaaatgaaagattccaaaggctattttgattttatattaaagaagggagcttgtttgtgtatcagtaatatagaaataaaacatagccaagtacttagttctatgatggggatatcttaactaccagttcctgtggcttacagggtagcaccatccgctggggcaggaatcccttatagagctggaaaataagcagaaaaaacccacatatcaatctttctaccctctctccttacctccctttcttctttcccaccaacaagaggtgattgagtatctaattgttacaagtacgaggaaccattctcccttaaaataagatcctggagcaaattaaaatgtgctgtagaccagttgtctggcagaaaattttaccagagtatgtagacaaataatgtaccctacacgatgggaacatgtcctagttaaactggaaattcacagaaggtcttccacaaagattttataatccaaaattataattatttcccaagtccccttctactttcttcctctttccaacacaatattgtgacccatgtgcataacaacaaagagcaagtaggggagagggcccagggaacctggcaaggagcgagagcttgctgctacatccctcaccatttttcctgtgagatgttgaaccctctcttacctaaaggccttgcctcatctttggtggaggcctttggtacaaataaggctccccaggtccccaagaccaaaaatcaaacatcttcaagttagacatcatatagagggacatatacattctttatatttccaactttgttcatagttggagttgggggcagtaactgactcccccaaaaaaacctatctccaggccctaacataaagttcaaaaacagctggaaccgaaaaaaaaaaaaaaaaaacaaattaaggcattgtgcagacagctggtcattcaaatcccttatgctttagctgtcagccagttgcccgaatcctcaggcccccttgtaattaacaccaggctccgtacaattagccacaggaccgggtgccagaaacagagtcaatcttcacagtaggaggtagggagaggaatcataaggggtcctggccttcacagagcacaggaccagggtggaggaaagggcatgacccaaaggctgcagtatcagggaggagcagggtctgtgtcataggaaaaaacaggccaaagactgtgagcctgtggaataaactgcagtcacttccagctgaacttggctgcagaagataagtttttgactgtggaggttgaccaagaggatattctaggcggaggcaaagataacatggtaggaagggtaagacggaggaggaagagaggacttatgcaatgggcatttactgagcccctactttgtgctacctaccatgccaggctctgagggcccagagtcctcaaatgtggatgcccaagtggcagtctataccaagcaaagcagagtgtcatcacagccaactttgtcacgtctcatggctggagatactaattagataatttcttccttcttttaaaggcctgattttttctgcaattcttaagtcacttcaaagttacttctccccaacgctcttcagagtcatccgcctggcccgaattggccgcatcctcagactgatccgagcggccaaggggatccgcacactgctctttgccctcatgatgtccctgcctgccctcttcaacatcgggctgttgctattccttgtcatgttcatctactctatcttcggtatgtccagctttccccatgtgaggtgggaggctggcatcgacgacatgttcaacttccagaccttcgccaacagcatgctgtgcctcttccagattaccacgtcggccggctgggatggcctcctcagccccatcctcaacacagggcccccctactgtgaccccaatctgcccaacagcaatggcaccagaggggactgtgggagcccagccgtaggcatcatcttcttcaccacctacatcatcatctccttcctcatcatggtcaacatgtacattgcagtgattctggagaacttcaatgtggccacggaggagagcactgagcccctgagtgaggacgactttgacatgttctatgagacctgggagaagtttgacccagaggccactcagtttattaccttttctgctctctcggactttgcagacactctctctggtcccctgagaatcccaaaacccaatcgaaatatactgatccagatggacctgcctttggtccctggagataagatccactgcttggacatcctttttgctttcaccaagaatgtcctaggagaatccggggagttggattctctgaaggcaaatatggaggagaagtttatggcaactaatctttcaaaatcatcctatgaaccaatagcaaccactctccgatggaagcaagaagacatttcagccactgtcattcaaaaggcctatcggagctatgtgctgcaccgctccatggcactctctaacaccccatgtgtgcccagagctgaggaggaggctgcatcactcccagatgaaggttttgttgcattcacagcaaatgaaaattgtgtactcccagacaaatctgaaactgcttctgccacatcattcccaccgtcctatgagagtgtcactagaggccttagtgatagagtcaacatgaggacatctagctcaatacaaaatgaagatgaagccaccagtatggagctgattgcccctgggccctagtgagaacactccagcctggatatgttcagttatgatgcgtccttctgctctgtgttaactctttcccattgcagatcacacccagctacagcctcaccaatgcatgccactggtcacaatgtcagaactgggcagggaatgcaactggtaaccacctttgaaaaaaccatcatacacaaataggagtcagaagctaagagcacttccactgtgatttcccttctgaatttcaatatcagatcatgggttctcttactctccagaaaatatcccttgtccttttatttttgttgtaatcagattatatttactgagacaaacttctcaggaccagaacttccaaagatatagaacaagaacattactgaaggtccaaggtagtcctctgtggagcaccatacagagattggcaatattatttaggattttgcatgactgcatgtgagagctgtcggacaactgctctgacccagggtaacacctgtggcctatgtcatgaaaagcctttgagatatccattaaaattaatatttttaaatgtatgtccacaccagcgttatatcataaagcatcattttatttttctcttatttctgtgatgctgacctgtatcatgagtcacttacccctcactttctgggatcctgatatttttcagtttgagattgaggctgggtggagcaggaaagagcactgtcctgggatctggaaatgccagttggaatcctaacttttccaccaattgtctggctgaccagggctaaagtctttcccctcttaacttcaatttcctcacttgtaaaattggtgggaagggaagaaaatgaatgctttctatagacttcgcatctcgtgctgtagaactccatggtgcctgccccatttatatgggaaaagcactcttttctgaggctgaaatggctggacctttctgttgtgtagctaaagaggcagcttttgaatacattccagagtctgttcacatctcataatcagacattaaggaggagagtttttacattacctggcgtccagaactccatagttaatataatcagaagaaaaagtataatcatgagaatgatgatccagtagataaaaggtatggccagtagtttctttcattcatcctgcaaatgttattaattacgtactatatgatgggcactgctccaagaacaagagataaaataggaattaagcccccaaaagattaattgtatgaactgaatggagtaagaattgtcagaggagtttatttaggccaaaggcatgttgcagattttgagatgaagaaaagcaaagactccctataacaacataggacatagggattgtaatgacagtcatgatcttccattaactcttggcccattcccagccacaatcacaaagattcaaatatatagccaattcattgtctatatatttgatcatttcataagattttccatttgtataattacaaagcacagtggctgatacatctcacatgcctcaagaatacagatttgccgaggccttgctctcccttttctgtcactattagcccataagaagtcaaagaggctctcaagatgcttactgggagttggcagcatccacagatgcaggttaataagatgatgatgggatagcagaggtaccaagccatctcaaatcagctattctctgaatgcctgatttattctaaaagatgagttcaaccaaataactcttcctctctcgtaccactgaacccgggagc

SEQ ID NO: 137 - protein, 1791 aa, Homo sapiens
MDDRCYPVIFPDERNFRPFTSDSLAAIEKRIAIQKEKKKSKDQTGEVPQPRPQLDLKASRKLPKLYGDIPRELIGKPLEDLDPFYRNHKTFMVLNRKRTIYRFSAKHALFIFGPFNSIRSLAIRVSVHSLFSMFIIGTVIINCVFMATGPAKNSNSNNTDIAECVFTGIYIFEALIKILARGFILDEFSFLRDPWNWLDSIVIGIAIVSYIPGITIKLLPLRTFRVFRALKAISVVSRLKVIVGALLRSVKKLVNVIILTFFCLSIFALVGQQLFMGSLNLKCISRDCKNISNPEAYDHCFEKKENSPEFKMCGIWMGNSACSIQYECKHTKINPDYNYTNFDNFGWSFLAMFRLMTQDSWEKLYQQTLRTTGLYSVFFFIVVIFLGSFYLINLTLAVVTMAYEEQNKNVAAEIEAKEKMFQEAQQLLKEEKEALVAMGIDRSSLTSLETSYFTPKKRKLFGNKKRKSFFLRESGKDQPPGSDSDEDCQKKPQLLEQTKRLSQNLSLDHFDEHGDPLQRQRALSAVSILTITMKEQEKSQEPCLPCGENLASKYLVWNCCPQWLCVKKVLRTVMTDPFTELAITICIIINTVFLAMEHHKMEASFEKMLNIGNLVFTSIFIAEMCLKIIALDPYHYFRRGWNIFDSIVALLSFADVMNCVLQKRSWPFLRSFRVLRVFKLAKSWPTLNTLIKIIGNSVGALGSLTVVLVIVIFIFSVVGMQLFGRSFNSQKSPKLCNPTGPTVSCLRHWHMGDFWHSFLVVFRILCGEWIENMWECMQEANASSSLCVIVFILITVIGKLVVLNLFIALLLNSFSNEERNGNLEGEARKTKVQLALDRFRRAFCFVRHTLEHFCHKWCRKQNLPQQKEVAGGCAAQSKDIIPLVMEMKRGSETQEELGILTSVPKTLGVRHDWTWLAPLAEEEDDVEFSGEDNAQRITQPEPEQQAYELHQENKKPTSQRVQSVEIDMFSEDEPHLTIQDPRKKSDVTSILSECSTIDLQDGFGWLPEMVPKKQPERCLPKGFGCCFPCCSVDKRKPPWVIWWNLRKTCYQIVKHSWFESFIIFVILLSSGALIFEDVHLENQPKIQELLNCTDIIFTHIFILEMVLKWVAFGFGKYFTSAWCCLDFIIVIVSVTTLINLMELKSFRTLRALRPLRALSQFEGMKVVVNALIGAIPAILNVLLVCLIFWLVFCILGVYFFSGKFGKCINGTDSVINYTIITNKSQCESGNFSWINQKVNFDNVGNAYLALLQVATFKGWMDIIYAAVDSTEKEQQPEFESNSLGYIYFVVFIIFGSFFTLNLFIGVIIDNFNQQQKKLGGQDIFMTEEQKKYYNAMKKLGSKKPQKPIPRPLNKCQGLVFDIVTSQIFDIIIISLIILNMISMMAESYNQPKAMKSILDHLNWVFVVIFTLECLIKIFALRQYYFTNGWNLFDCVVVLLSIVSTMISTLENQEHIPFPPTLFRIVRLARIGRILRLVRAARGIRTLLFALMMSLPSLFNIGLLLFLIMFIYAILGMNWFSKVNPESGIDDIFNFKTFASSMLCLFQISTSAGWDSLLSPMLRSKESCNSSSENCHLPGIATSYFVSYIIISFLIVVNMYIAVILENFNTATEESEDPLGEDDFDIFYEVWEKFDPEATQFIKYSALSDFADALPEPLRVAKPNKYQFLVMDLPMVSEDRLHCMDILFAFTARVLGGSDGLDSMKAMMEEKFMEANPLKKLYEPIVTTTKRKEEERGAAIIQKAFRKYMMKVTKGDQGDQNDLENGPHSPLQTLCNGDLSSFGVAKGKVHCD

SEQ ID NO: 138 - DNA, 107193 bp, Homo sapiens
aaggttctccaaggccccaccagagcagctagatacagagtgtcgattggtgcactcacaaaccctgagctagacacagggtgctgattggtgtatttacaatccctgagctagatataaagactctccacgtccccaccagactcaggagctcagctggcttcacccagtggatcccgcaccggggccgcaggtggagctgcctgccagtcctgcgccatgcgctcgcactcctcagcccttgggcggtcgatgggactgggcgccgtggagcagagggcggtgcttgtcggggaggctccggccgcacaggagcccatggagggagtgggaggctcaggcatggcgggctgcaggtcccaagccctgccccgcgggaagtcagctaaggcccggtgagaaatcgagtgcagcgccagtgggccgactctgctgggggacccagtacaccctccgcagccactggcccgggtgccaagcccctcactgcccgggccggcagggccagccggctgctccgagtgcggcgcccgccaagcccacgcccacccggaactccagctggcccgcaagcgccgggtgcagccccggttcccgctcgcgcctctccctccacacctccctgcaagctgagggagccggctctggccttggccagcccagaaaggggcttccacagtgcagcggtgggctgaagggctcctcaagtgccgccaaattgggagcccaggcagaggaggcgcctagagcgagcgagggctgtgaggactgccagcacgctgtcacctctcactttcttagggtcgaagtcctagaagtgagagagccggcatgggggtcgcagttcatgcctatgtttatggctcttttgttcccatttcatcacattttaagaactttactgactggatgtgagaaaagacccatgcactttcagttttgcttttgcaatccataactatggcccagtcaattccctgttcctttttctcttgtttgggccatgtggccacttgcctgctacttgcagatcccacttcagcagttcagccggctcagccttattgtcttgcttaatgtctgggtctcagttttagagactgggcttcttctgctcacttgttcctgaactcaacttcccgccttttgccaggtcctccaggaatgatgccctgctttggttttgtctatgccaaaagttcctgctatacccacagtggtggtcatctcttctgatcttcacagccaatcagctcccaaggcccctgacctcagctcagcttttgtagatccttatgacaccatcctttaagactggaatcctagggcaggctgttttattcccgcctcctgaggcctttctgaggatctgtggcttgtctctgtcctgagggtgaagatggatgacagatgctacccagtaatctttccagatgagcggaatttccgccccttcacttccgactctctggctgcaattgagaagcggattgccatccaaaaggagaaaaagaagtctaaagaccagacaggagaagtaccccagcctcggcctcagcttgacctaaaggcctccaggaagttgcccaagctctatggcgacattcctcgtgagctcataggaaagcctctggaagacttggacccattctaccgaaatcataaggtacttcattgggcggggggggggggtgggggtgggggtgttctaaccatgcagttgtaactggtgttacaggttctccaaacaccactcttagggtttatagcaggcaggctgtgcctcttctttgctgtcatcccctggcattgccttgatagtcctgaaaacccctttcagtcctcattttttctctgcaatgcatgtattagaggagaagatgaggatgagggactgcaaaaggataaaaggaaaacagagaaaacacaaaatgaagtctggaaagaggactggactagtagtcccagaagttagatacaggccatttcaattgattggctttatgactctgggcaagtcactttactaatcttcacttttaaaatctgtataatagaaataatgcctgatgttcctaccttagagcatagacatgctgggaaagcactttatcactataatgcattatactgatacaaaggattaatatcatggtccagaaatgctcattatagcaacaagattttaccttaaaaactcttggataataggctttctaggctattaaatgagactaatagggctcaaaccaacaactgatgcatagtaggagctcaataaatgaaacctaagaaaatggtaaccaagtgggcacatgcagattctatgtaaactcaatgcaaatatgtgaaagccttgctattttatctgcctggatgcagttcttgcagggaaattctagtaaaggtttcttgaaggggctcccgagtgagggaatgtaaactttgagctcccacatgactgctctagagcctgaggctgtgagcacacttggccctttcaggaaaggctcagaagattttgccatcatcacctcgcagtgtgatccagcagaggttggaaaccccaccttgccatactgaggttagagacctaggaggctgggaggtttggggaagccctagaaaatatgggatgctgagagcatctttggctggcatccataagaaactgacctttcaaagaaagattgcctgatttgcatgtacttcaattgggatagacttagagttgccaggccaaatgaggaccacatatacagaggaaagtagagtataagtaggaaggacaagcaagggggaaagaattgaaggagcaaaaacactccaatgtttctcctttttctgatgccccaggattccagggccttcttggaggtatagttgttggaggtgagttaactgtagaggtctccttctgcatcaatgctggagaggagacgcatgagtcaggcagcagtttggtgtgcagctgacagtccgggagaacaggactattccagcctgggtggtaattctaggaccaccacttctcagcctgggtcctcactttaaataagaagacacgatatctgtttagagctctgcacacccatgatctcacatgaccagtgccctcaacagtcatgtgaggtatgtgtgatcatgattagcactctaccttacagatgaggaaaccagagcctagctgggaaagtggcttaagccaggtcaagcagccagtgagtggtggagctaggatgcaaacccaagggtgctttttatcatcacaggctacttctctttggaagccccattttgaagagcaacaggggaaagaagtagagaagtgtcagcaagcaggcaggaggagctagtacctatcattttaatcattaaaaccctggcatgtagagttaaatacaccattagttaaaatatttaaagcagtaagaagaggcatcaataaaatatcaaaatcaaaggcacagaaggagagccatattgtaccacttattaatgtggggtgactcatctcaaagagaggtttgtttctgccccaaaattgtatgtctgttcaaaggaaaggcgcagaatttccaaagcaggtcttgggctcctggctcatatttttaaaaaaccccgtggctcatttcattattatgggggcaaagaaaaataccctagcacagttttccctgcagccagataaccatcagaccagtcaatcccagcagctcattaaaggaaggttgatggttggcagtggctgacgttctggcacctgagccaaggtagcactcacagtgctaacgttgggcctgggtgccgaggtctgtctctcctgcctgagaacatgctgtattacatggccaagtagtactttttgcaaatctgaaaggagccatcagttggggagaaaggaatgactcttactttctgaaggcttttgtaactgatagccatggggacagatatggggacagctagattacagttacatggaaaaagggaggtctggaggtggatgttagaagcatgttagtgacaggttgttgtccaggggctgcttcattcccagtgcccagggagtcatgctaggagaaaatgggcagaggttcagtgttctttaatgggactccactgggcactttgtgggggggcgggcataatgtaccattggcaagtttgtcctgtttggcatccctgggtcttcccagtaaaaggccggtagagcccatagtcattacagcagacaaccaaaaatactcacacacatttccaaatgccttctgtaggggcaatgcccacctcccctgctggttaagaaccacagggaaatttgcccctatgtccacagaggtaaagaaagagcaaatccaggaaacttggtgacttttttcttgaagatcatcaaggttagaattgactggttatttcacacagcatttctcagacctgtggcatagcaaacatggaccctttaggtcacttattctaagattcattgcaaagttttcgttaataatcaaaataatttaaaataatctgctgaatctaaatgtccaagctcaatttctgcctcttcaagttctcttctagtccctttccccgttgatacgtaccatggagtacaatattaagggttttcttttccccagttattcctctatactcctaattttggtattttcaggtcctgtgttttccatctctgattcttctggagtatcccattgggtaaatattccacagcccaacagtttatgttataattttctctaaatgaattcatgataaatattgttttgtcactgcatttaattcctgttgtgtatgtgtgtgttttcttgtattgttttttttgttttgcagacatttatggtgttaaacagaaagaggacaatctaccgcttcagtgccaagcatgccttgttcatttttgggcctttcaattcaatcagaagtttagccattagagtctcagtccattcatatcctttcattgcaccttttactaagtccagatcatttgaaaagtgcacgtgccccacggtgttcatgttattggatggaagcaaatagctaattctttctacaaatactggctgagtgcctactgctgcaggcagggactgtgctggatgtgagcaagatgtcgtctccttctctggggtcctatggcctcagaagggcatagactaaaaggcaggcaacttctttagtgagattggtcgtgtgaaagtggtagcagggagaggcactgctgtgctttagaggcatcaaggatggcttcttagaggaaggtgcatctaagctgacacctaaagagttgtaaactggcaacctgtgcagtatattgagttgataatgtgttgtgttggacctacacagtatttaaaactttgaaaaacactttctaacatgaatactccagatttccagcttttcttgaaagatggaaactggcaagggtaggttcccatttctgttaatacctgacaaaaatgggtagagtaaggaattgctgcctctttggagggggcatgtaagctctgtctcaccacctctgcacccctcttgtggctgaacaccagcccattttacccatttatatgccttttcaggctcttaaaacttagggtttgcaatgtcagtcttaaaatgtaaaggcaggtaggaattattaagcatttctgctgtatgccagggttgggggagacactaggaagttttagacagggaaatgagaaaaagatatgggttggtagatttagtaaaatattgaggagaatggcaatgaataactatttgggtttggttccctagaagcagagcctgatatgggcattcttatttaagtgatttaacagaggagtgctttctggagaaggagaaagggaagcagaaggggggaaaacaaagagccaagcaaggatatggtctcagctgagtcaccttcattctgatcccacgaagaactctggagcatgaattgcaccacagaattgtcccactttgaagcaagggcctaagtcagtcagacatgtagaagggggtgtgtagctctccaagtgaggaggctgccattcagcaggggacaattctccacaggaggggacagttgtgagttgttctcatccaacattcacagtcagaagatagatgcacctgcagaaaaggggaccatcaggggcacccccagtcttacccagtagctaatgatgcatgccatcctgcaacatatctgccttaatggatgctggccacattgttcagcatgttcattatcggcaccgttatcatcaactgcgtgttcatggctacagggcctgctaaaaacagcaacagtaacaatactgacattgcagagtaagtatttttccttcactcacctgtcctaagtttttaaacaaatatacctaagacagttaatgattacactggagagaaagaaaaagtcactaataattctaacacatatgttggcagaatcagttttatttttgacctttatttttttacaatttgtaatgaacagcacacatatgttcacattttaagtggttttctttgtgtttacataagttttataggtatccattttgatggttatataatattttatcaggtgaataaaccataatgtacttcaccactctagcattttagtagattgtaacattgtcataaaaatctttttgcataaagctgtatttatgtatttacttattctttgtttttgtttgtaaaaaattgttatgggagttcactatgccaaaaataaagctattctttttttatttttttttattttttgagacagggttttgctcttgttgcccaggctggagtgcaatggcactatctcagctcactgcaacctctgcctcccaggttcaagcgattctcttccctcagcctctcaagtagctgggattacagacgcctgccaccgtgcccagccaatttttttgtatttttagtagagacagggtttcaccatgttggccaggctggtcttgaactcttgacctcaggtgatctgcccaccttggcctcccaaagtgttgggattacaggcgtgagccactgcacgcagccctattcttaaattattattttcttgagatacactcttagaaatggattttctaggctgggcgtggtggctcatgcctgtaatgccagcactttgggaggccaaggcgggtggatcacgaggtcaggagatcaagaccatcctggctaacatggtgaaaccccatctctactaaaaatacaaaaaattagccaggcgtggtggcgggtgcctgtagtcccagctactcgggaggctgaggcaggagaatggcatgaacctgggaggcggagcttgcagtgagcccagtgagccactgcattccagcctgggcaacagagtgagactctgtctcaaaaaaaaaaaaatggattttctagataaaaaggtacattttaatgcttttaatgatatatatagacaaaatgttttccaaaaagtttgtatcaatttgctctgccatcagcagtgtattctaataaccaattatatcacattcttgctagcattaaattttttcttctctaatttatggagttaaaaatattagcatttctttaatttccagatgggttagacttaaaacaattttaattgacacataataattgtacacatttcagggtacatgtgatattttgatacatgcatacactgtgtaatgatcacttaagggtaattgggatatcaatcccaattggacatttattatttccttgtattggaaacatttcaaatcttctcttctagctattttgaaatatacaataaattattattaactaaatagtcatcccactgtgctattgaacactagaatttattctttctgtctgttttttgtactcattaatcaacttctctccattcctcacctctcacccagtctttccccatctctggtaaccaccattccattctctacctccatgtgatccactttttcagttcccatatatgaatgacaacatgaaatatttgatttagactcttttaatgttttcatttctgaattgtgtgtttccatctttgcttctgtatcatttttatttcttttctaatcagtttgagttctctgtataaccaaaatattaactttttatcatttgcattggcttttcagacatatgaattaatgttttaacttaaaagttctatatttgtataaatattttcttatcaaaagttccagtttttctagtttaacataattactgctttaatctttcaggaacatattgaatgcaaattgaataaatgagaccattttttctaactcctatttaattatgcaatataaaccactgcaatcgatatatagaccatttcaattaccccccaaaacgtctcatgcctctttgcagttaatccccgattcccactcccaaccccagacaaacatcgatctcatttctgtcattctagacttgttttgccttttttaagaatttcgtatacatttcatatgctatgtatgatactatatttttgtatctggtttctttcatttagcataatgctttgagatgcatccatgttgttgtgtatatttctacattttttttttctttttgttgctaagttggattccattgaatggatatagttttcccatttatctattgatgcacatttgcattatttccagtttagggctattatgaataaagttgctgcgaacacttccgtataaaaatcttttgtggatatttttgcatttctctgggataaatacctaggtgtaattgctgggccctgcgataagtatatatgtaactttctaataaactgctaaacctttttcaaattgacagcataattttacattcatatcagcaatatatgaaagtttcaaagtctttattaattttttcattcaatttgctttgattttaatttgctcttctttttctagcttcttaagttggaagcttaaatagttggttttagatttttcttcttatacaattgtataaagctatgcatttctgtccaagaactgctttagctgcattccacagatgtcaatacactgtgtttttattaccttttggttcaaaatattccctacattttctcatgatttcttctttgtcccatatgtcatttagaagtgtgttttttaatatttccaaatattttatacctttctagttgttttctggttgtctgattattatctaatttcagttcagttatgatcagagaatacactctgtaaaatttcaatcttttgaaataaagagaaacatcttttatagtctatcttgggaaatgtttcacatgcacttggaaagaatgtggattctgccacattcttaaatactccttaaaaggtcagttaagttaaggtggttgatagtgtcatttagatcttttgtacctttactgatttttacttagcatttttatgaattactgaaagagaggcttgaaatctctatctatgattgtggatttgtctgttctttctctctttttgtcaaatttggctttgtgtattttgaagcactattatcaggtacatacatatttacgatgattattattatcctcctgatgtattcattcttttattattatggaatgtcttctttgtctctaataatactcatttaaatatttgttttgtctaatattaatatagctacttcagctttcttaagctctttgtttgcatggtatatctttttccattcttttactctcaaaccttctgtgtctttgtatttgtagcgtatatcttgtaaacaacatatagttggtttttgctttttatgcagtctatcaatccagtctctgacttttgatgactaaagttcatttacatttaatatagttatataattggattttgctttgctatttttctattggttttctatttatctctttttttttttgtcattgttgttgttcctttgctactccattatttctccattcctgcttccttttgtgttaatcatgtatatttagtatttcattttaatcctctgctggccttttagctttacctatttgcattttttagtggtttcttcacatattaaacaatgcattgttaaattggcaaaatagagttaacgttgaattccttcaagtgaaacaggaaccatgccacagtttagtcccctgtttgttttttatcatatagttatgctaatgtacacaataaacccaacaatacagtttatcatttttgcttttaatgggcacatgccttttaaagacattttttttcctgtagatccaagttatcttttggtagtatttctttttagcctgaacaacttcctttaatatatcttgtggttcagttctgttggcaacccattctcagtttatattgatctgaaaatgtctttatttcatactcatttatgaagtagagtttcattgtatatagaatcagtgcttgacaatttgtttttctagcactttaagtatgtcatttccatgttttatgcctcctgttgcttagctctctcttgcatgcttccaggatttcctccctaaatttccagctgctctgccagctctgaaccccaccctcggccaccttaaatcttcaggactgcagccatttgccagtgttggggtgggagtggggaagttggaaaacactctcagaccaaaacagttaaacattttcataattcttatgcattgcaggtaccttcttttaaggggaaactctgccccagtttctgcctccttttgtttaccttccagggccttcaaataattgtccttatatatatattttccagtttaatactcattatctgtgggagggtttgcccagctacttcatgtcttcatcacaattgaagcaggcatcaatggtctcttaattttgcttattatttttttcttttcctttattaaatttaacaaactttcctctatgcccgtggattttgatttatagttagaaacactttctctagccttgagttataaaaggactctctcatattttcttacagtgcttttatagtttccttttttaaaaatttaaatccttgaataatttggaattcattcaagggtagggtgtcataaatagatctgacttcatagttccgtcccagatgtctatccatttgtcccaacaccatttgttaaatagtccacctcttatcctctgatgtgaaatgttacttaggtattcagatctatttctggactttcttttctcttccattggtctgcgttttcatatgccagaaccacactttttaactatcaagattgtctaatgttgtaatgtctaggagtgctagaggttccttttgagaatttttatggctcttgttgattttttcatgtaaattttatagtcaacttggttagttttattgacatgatgaaaggatttataaattaacctagaggaaactgacatctttatgaggttggaactcattgagaacatgacatatttttcatttgttaaaatcttcttttgtgttcctctaattgctttaaagttttcttcatacagatcttccacaattcttgttaaatttgtttgtgaattttactgttttttgttgccattataaatgtggtcttttctttcattatgccttgtaactagttgccttgttatataaaactatatatatatatatatatgtatgtacatcagtattatacatatcaatattttatatatatataaaattgtgtgctatttttgataaaatttgttgtcagcatttgtttactcttttgatgacttgtatggctcctccccatctttcccatgtattaaattttttttttttttgagatggggtttcactcttgtcgctcaggctggagtgcaatggcgcgattttggctcaccacaacctcctcctcccgggttcaagcgattctcctgactcagcctccagagtagctgggattacaggcatgcgccaccacacctggctaattttgtatttttagtagagatggggtttctccatgttggtcaggctgatctctaactcccgacctcagatgatccacccgcctcggcctcccaaagtgctgggattacaggcaagagccactgcgcccggccttgaaatgtttttaatagcatggaaatgaggtattctgggagaaagaaagagagaattatccagtaaagtgatttatatctgcaaatcttttggagagggatataaggaattagtgaaatgggaaggaattcatttattaatagctttttcatttttcattggtaatctttttcagttttaaaatttctctgaatattttgctatattcttcttctcatttatcattttgttcatatgttttcttttttctgtgattagaattgccagaggcttgcctatttttatgtttttttaaactatatcttaaattccattttaaaaactattctatagtttttctataactatgtcttaaattctatttgtcttaaattctatgtttttctaaaactatatcttaaattctatttatgtattaaattctatttttattttattagtattttttgagacagaatctcgctttcttgcccaggctggagtgcagtggagcaatctctactcactgcagccttcgcctcctggattcaggagattcttgtgtctcagcctcccaagtgactgggattacagacatgcaccaccacgcctggctaatttttgtatttttagtagagatggggttttgccatgttgcccaggtcttgaactcctggactcaagtgatccgcctgcctaagcctcccaaagtgctgagattacaggcatgagccacagcacctggccttaaattctatttaaaaatataatatttttggccgggcgccgtggctcaccgcctgtaatcccagcgctttgggaggccgaggcgggcagataacctgaggtcgggagttcaagaccagcctgaccaacatggagaaaccgcgtctctactaagaatacaaaattagccgggcatggtggcacatgcctgtaatcccagctactcaggaggctgaggcaggagaatcgcttgaacctgggaggcagaggttgcagagagcagagatgatgccattgaacgccagcctgggcaacaagagcaaaactctgtctcaaaaaaaaaaaaaaaaaaaaaaaaaaaaaaatatatatatatatatatatatatatatatatatatatatatgatatttttccttctgccttcttttattttcttcattatacattcaataggacataacattttctaaaatatgaatttgaatgtttagttcatgcattttccttcttttttgttttttattttattattattatactttaagttttagggtacatgtgcacaatgtgcaggttagttacatatgtatacatgtgccatgctggtgtgctgcacccattaactcgtcaattagcattaggtatatctcctaaagctatccctccccactccgcccaccccacaacagtccccagagtgtgatgttccccttcctgtgtccatgtgttctcattgttcaattcccacctatgagtgagaatatgcggtgtttggttttttgttcttgcgatagtttactgaaaataatgatttccaatttcatccatgtccctacaaaggacatgaactcatcattttttatggctgcatcgtattccatggtgtatatgtgccacattttcttaatccagtctatcattgttggacatttgggttggttccaagtatttgctattgtgaatagtgccgcaataaacatacgtgtgcatgtgtctttatagcagcatgatttatagtcctttgggtatatacccagtaatgggatggctgggtcaaatggtatttctagttctaggtccccgaggaatcgccacactgacttccccaagggttgaactagtttacagtttacagttccaccaacagtgtaaaagtgttcctatttctccacatcctctccagaacctgttgtttcctgacttattaatgattgccattctaactggtgtgagatggtatctcattgtggttttgatttgcatttctctgatggccagtgatggtgagcattttttcatgtgttttttggctgcataaatgtcttcttttgagaagtgtctgttcatgtccttcgcccactttttgatggggttgtttgtttttttcttataaatttgtttgagttcattgtagattctggatattagccctttgtcagatgagtaggttgcgaaaattttctcccattttgtaggttgcctgttaactctgacggtagtttcttttgctgtgcagaagctctttagtttaattagatcccatttgtcaattttggcttttgttgccattgcttttggtgttttagacatgaagtccttgcccatgcctatgtcctgaatggtaatgcctaggttttcttctaggatttttatggttttaggtctaacgtttaagtctttaatccatcttgaattaatttttgtataaggtgtaaggaagggatccagtttcagctttctacatatggctagccagttttcccagcaccatttattaaatagagaatcctttccccattgcttgtttttgtcaggtttgtcaaagatcagatagttgtagatatgcggcgttgtttctgagggctctgttctgttccattgatctatatctctgttttggtaccagtaccatgctgttttggttactgtagccttgtagtatagtttgaagtcaggtagcgtgatgcctccagctttgttcttttggcttaggattgacttggtgatgtgggctcttttttggttccatatgaactttaaagtagttttttcctattctgtgaagaaagtcattggtagcttgatggggatggcattgaatctataacttaccttgggcagtatggccattttcacgatactgattcttcctatccatgagcatggaatgttcttccatttgtttgtatcctcttttatttcattgagcagcggtttgtagttctccttgaagaggtccttcacgtcccttgtaagttggattcctaggtattttattctctttgaagcaattgtgaatgggagttcactcatgatttggctctctgtttgtctgttgttggtgtataagaatgcttgtgatttttgtacattgattttgtatcctgaagactttgctgaagttgcttatcagcttaaggagattttgggctgagacaatggggttttctagatatacaatcatgtcatctgcaaacagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccattcaatatgatattggctgtgggtttgtcagagatagctcttattattttgagatacgtcccatcaatacctaatttattgagagtttttagcatgaagggttgttgaattttgtcaaaggccttttctgcatctattgagataatcatgtggtttttgtctttggttctgtttatatgctggattacatttattgatttgcatatattgaaccagccttgcatcccagggatgaagcccacttgatcatggtggataagctttttgatgtgctgctggactcagtttgtcagtattttattgaggatttttgcatccaagttcatcaaagatattggtctaaaattctcttttttggttgtgtctctgcctggctttggtatcaggatgctgctggcctcataaaatgagttagggaggagtccctctttttctattgattggaatagttcagaaggaatggtaccagttcctccttgtacctctggtagaatttggctgtgaatccatctggtcctggactctttttggttggtaagctattgccacagtttcagagcctgttattggtctattcagagagtcaacttcttcctggtttagtcttgggagggtgtatgtgtcgaggaatttatccatttcttctagattttctagtttatttgcataggggtgtttgtagtattctctgatggtagtttgtacttctgtgggatcggtggtgatatcccctttatcattttttattgcttctatttgattattctctcttttcttctttattagtcttgctagggatctatcagttttgttgatcctttcaaaaaaccagctcctggattcattaattttttgaagggtgttttgtgtctctatttccttcagttctgctctgattttagttatttcttgccttctgctagcttttgaatgtgtttgctcttgcttttctagttgttttaattgtgatgttagggtgtcaattttggatctttcctgctttctcttgtgggcatttagtgctataaatttccctctacacactgctttgaatgtgtcccagagattctggtgtgttgtgtctgctctcgttggtttcaaagaacatctttatttctgccttcatttcgttatgtacccagtagtcattcaggagcaggttgttcagtttccacgtagttgagcggttttgagtgagtttcttaatcctgagttctagtttgattgcactgtggtccgagagacagtttgttataatttctgatcttttacatttgctgaggagagctttacttccaactatgtggtcaattttggaataggtgtggtgtggtgctgaaaaaaatgtatattctgttgatttggggtggagagttctgtagatgtctattaggtccgcttggtgcagagctgagttcaattcctgggtatccttgttaactttctgtctcgttgatctgtctaaggttgacagtggggtgttaaagtctcccattattattgtgtgggagtctaagtctctttgtaggtcactcaggacttgctttatgaatctgggtgctcctgtattgggtgcatatatatttaggatagttagctcttcttgttcaattgatccctttaccattatgtaatggccttctttgtctgttttgatctttgttggtttaaagtctgttttatcagagactaggattgcaacccctgcctttttttgttttccatttgcttggtagatcttcctccatccttttattttgagcctatgtgtgtctctgcacatgagatgggttttttcctgaatacagcacactgatgggtcttgactctttatccaatttgccagtctgtgtcttttaattggagcatttagtccatttacatttaaagttaatattgttatgtgtgaatttgatcctgtcattatgatgttagctggttattttgctcattagttgatgcagtttcttcctagcctcaatggtctttacaatttggcatgattttgcaatggctggtatcggttgttcttttccatgtttagtgcttccttcaggagctcttttagggcaggcctggtggcgacaaaatctctcagcatttgcttgtctgtaaaggattttatttctccttcacttatgaagcttagtttgtctggatatgaaattctgggttgaaaattcttttctttaagaatgttgaatattggcccccactctcttctggcttgtagagtttctgccgagaggtctgctgttagtctgatgggcttccctttgtgggtaacccgacctttctctctggctgcgcttaacattttttccttcatttcaactttggtaaatctgacaattatgtgtcttggagttgctcttctcaaggagtatctttgtggcgttctctgtatttcctgaatctgaatgttggcctgcctttctagattggggaagttctcctggataatatcctgcagagtgttttccaacttggttccattctccctgtcactttcaggtacaccaatcagacgtagatttggtgttttcacatagtcccatatttcttggaggctttgttcgtttctttttattcttttttctctaaacttcccttctcgcttcatttcattcatttcatcttccatcactgataccctttcttccagttgatcacatcagctcctgaggcttctgaattcttcacgtagttctcgagccttggctttcagctccatcagctcctttaagcacttctctgtattggttattctagttatactttcgtctaaatttttttcaaagttttcaacttctttgcctttggtttgaatttcctcctgtagctcggagtagtttgatcgtctgaagccttcttctctcaactcgtcaaagtcattctccgtcctgctttgttccgttgctggtgaggagctgcgttcctttggaggaggagaggtgctctgccttttagagtttccagtttttctgctctgttttttccccatctttgtggttttacctacttttggtctttgatgatggtgatgtacagatgggtttttggtgtgggtgtcctttctgtttgttagttttccttctaacagacaggaccctcagctgcaggtctgttggagtttgctagaggtccactccagaccctgtttgcctgggtaccagcagcggtggctgcagaacagcggatttttgtgaaccgcgaatgctgctgtctgatcatttctctggaagttttgtctcagaggagtacccggccgtgtgaggtgtcagtctgcccctactggggggtgcctcccagttaggctgctcgggggtcaggggtcagggacccacttgaggaggcagtctgcctgttctcagatctccagctgggtgctgggagaaccactgctctcttcaaagctgtcagacagggacatctaagtctgcagaggttactgctgtctttttgtttgtctgtgccctgcccccagaggtggagcctacagaggcaggcaggcctccttgagctgtggtgggctccacccagttggagcttctcggctgctttgtttacctaagcaagcctgggcaatggtgggtgcccctcccccagcctccctgctgccttgcagtttgatctcagactgctgtgctagcaatcagcgagactccgtgggtgtaggaccctccgagccaggtgcgggatataatctcctggtgcgccattttttaagcccgtcggaaaagcgcagtattggggtgggagtgacccgattttccaggtgccgtctctcacccctttctttgactaggaaagggaactccctgaccccttgtgcttcccgagtgaggcaatgcctcaccctgcttcggctcatgcacggtgcgctgcacccactgtcctgcatccactgtctggcactccctagtgagatgaacccgttacctcagatggaaatgcagaaatcacccatcttctgcgtcgctcacgctgggagctgtagactggagctgttcctattcggccatcttggctccagcctgactgcattttccttcttgttgtaaataataaaaatatttatagggacaatgcttaggggtacagctttgtctctgtcttgtaggttttaatatgtggcatttcaatttttaatattttctaaatgtcttttgtattcttattttcccttcctctttggttcagtttcttgcagattcttctttaaggatgtttatagtaacatttgtggtatctgacttggcaagttgcaagtattgtactacatttcccacattagttacccttgtagctgtacttttcctttcagatcctctagtaattcaaagagacccactcaggttcaggcaaatataagaagcttcttgtgaatggaatggcttatctaatatttctaaaatgactggagcaatgacttactgtttctaaggcttgagggacttgggcgcagaggcaaaaaatcactcccgctagaggtatgatggtgaaagctggctagcagctgtttgtacctctggtggggagtaggactggggactcccagaccttgcaggcacttattagggaatacaacatcatcaggaaagggactatgtgaacaaggttggatgctccaaggaaaaatggattgatgaccctgggaggctttcctcctggaatctgggcaatgcccactctcgtcatgcttctttagaacatgttcttattttcaaatgttttcatagattttaaatgggaatttgggaaggcagtctccagtcacttccaccctacctttttcctggaagtgttctctaaatcatgtacacatctattctcctttacttggctctagtggtttctgggacaccggttagtggtcagactttgaaaactgccctttctttgactacaaggtctggtttggtctatatgtctctggagaattcttctcccttctaggtggtgtctttgtagggactgtctgtctctgttgctgggtggaacctggaacctggttaaggctggccagtggaggggctgtgccttgaggagggcacagatagccccaggaataggtgccatcctggcaatgtccttggggaatgtggtctcccctttggagatttggctgttgcatgaggtgctaactgagtgcaggggttgctactcgttgcttactgcagcttccctggaagcctttgatgaggagggcaggacctatggaggagacagatcaggagagtgcattgtttccacagctgcggtttgctctgcctagcccttgtggtgagatgcaaggagccttctttctctattatgggaaggtaatttgctctgaggccattttcactattaaaatacccataaggcagggaggaaaacccctctttaagcagagaggcaggagtcaagtgtggggaaagctgttgctctcccctggaagttttggatgaacagtggatacgtgaatgtggggtgggaggaggctgttaaaaatgtcttcatacaaggaggcatgtaatttcctcctggtgggcatggttttactccacatcagatgtcattttgatctgcctgtcccatcaatggtcaggcttcagctggaaaagagagaatggtggaagtaagaggtgggagactagaatgtcaggcagaaacagcagcgacagtctgctgtctcatttgcttaagatctgtatgaagacttgaaaaatcccacaaatctgcaattgcagatttttatcaaagcatctataactttataatttaaaactggtattaaaagatgttgcctttttaaactcttttaatgcctgtttatatgaggacatttttaacaacctcctgcaaccctacattcacacacacatattttaggacagacattatttaatctgatatgctcatttgtcacacaaaaggtgagcagctcagaaaaagcctgaagcaaggaggagctcttgcctgtagcagcctcatgaccatttctgctcttggacttggctgctttgagttttttcaagtcctcaaggcctttgttctttagctttcagggctattatgactggatagtttaccagaaaaggtccacttcttttactctgaactgataagctgtttaactgaattgcttgtttctgtcccaagtgagcgtgtgtatgtgtttgtgcttgcagactcagtatttttgcagcttgggattataacaaaagatacgagattttttttttgagacagcagataaaaagggaaataaattagagaattatcttagtcaattttatgttgtgataacaaaataccacagactggataatttgtaaagaatacagatgtatttcttacagttctggagactgggaagtccaagatcaaagggtctgtatctggtgagggtcttcttgctgcatcatcccatggcagaaggcagaagggcaaaaatgtgcacatgagagagcaagggtaaagaggcctgaactcaccttttatcaggaacccactcctgagatattggcattaatacatcacaaaggaagtgtcttcatggcttaatcacctcctaagggtcccacctcttaataccataataatgccaattaaatttcaacatgacttttggagggaacattcaaaccatagcaaggatagaatatgatggaagattcagggaagagaaaggaagggcccagtttttattaaaattgtgacaaagtacacataacataaaagataccgtcttaactattttaagtttattggaattaagtgcattcacagtgctgcacaacattatcattattcatctccagaactcttttcatcttgcaaaactgaaagtctatatccatgaaataccaactccccatttcaatcttcccctcagcccctgcctcatataagtggatcacacagtatttgtctttttatgactggattgtttcaccttgcataatgatttcaaggtttatacatgttgtagaatgtggcaaaattttcttcctttttcaggctgattaatattccatcacatgtatataccacattttactctgaactgacaggttgtttgactgaattacttgtttcagtcccaaacatgtgtgtgtgtgtgtgtgtgtgtgtgtgtgtgtgtgtgcgtgcacagacccagtatttttgacagtgtgggaatataaaaaagatgtaagctattttctttttttaggagattgtctacttatctggcaaagggcatttgggttgcttccacctctttgttattatgaacagtgctgctatgatcatgggtaggcaaataagttcttgagaacctgctttcaattcttttatacatatacctagaagtggctttgctggatcatatagcaggtctatttttaatttttgaggagtcttcatactgttttccatagggattgcaccattttacaatctcatcaacagtgcacaagtgttcccatttcttcacatcttcatcaacacttgttattttaggttttttaaaaaatagtagccatcctaatgggcatgaggtcatctctttgtggttttggtttgcatttttctaatggttagtgatgttgagcatcttttcatatgctcgttggccatttgtatttcatctttggagaaatatctattcaaatcctttggtcattttttaattaggtcatttaattttttattgttgagttgtaggagttctattttattttattatttaatttaattttattttactgtaagttctgggatacaggtgcagaacatgaaggtttgttacatagctgtatgtgtgccatggtggtttgcttctccatcaacctgttatctaggttttaagccccacatgcattaggtatttgtcctaatcctctccctccccttgctccccacccccaacaggccccagtgtgtgttgttcccctccctgtgtccatgtgttcttattgttcaactcacacttagagtgagaacatgcagtgtttggttttctgttgtcagagttatttacatattctggatgttaaccccttgttaggtatatgactttcaaatttttcttctatgagttttatgtttttcaggtcttacatttaggactttaatccatattgagttaattttttatatggtgtaagtaaagattctaacttcattttttgcaagtggagattcagttttccctttaccatttgttgaaaagactgtcctttttccaaggacattgccaagactattccatagtcttgtcacccttgtggaaaataatttggccatatatgcaaaagtttacttctgggctctctattctattccgttggtctatatgtgtctttatgctagtaccaccttgatatggtttgtctgtgtccccacccaaatctcatcatgaattgtagtacccataatcctaacgtgtggtagagggccctggtgggagataattgagtcacggcgagggtttcccccatgctattctcgtaatagtgagttctcatgagatctgatagtttcattaggggctttccccttcgcttcactctcattcttctccttcctgctgccgtatgaagaaggacatgtttgcttccccttccaccataatggtaatttttctgaggcctccccagccatgctgaactgaactgtgagtcaattaaatctctttccatgataaattaccctattttgattactgtagctttgtaataaatttcgatatcaggaagtgtgagacctcacaatttgttttttttcaagattgttctggctatttggggtcacttgaaattccatatgaattttagaatggatttttatatttttgtaaaaaatgtcattgggagtttgataaggattgcactgaatctgtagatcaccctgggtagtacgatatcttaacaatattaaaccttccaatccatgaacacaggtatgaaaaaattcagctatttgcttgtcatttactctcttcattgttctgtcaccattgtctccttctgtacatcagagtgacagctctagaatggtggtgacaaagtacaacctccagtgcttgggtctcatgttacctgaaactattctcaagaatatggacataaagctaggccttgaaatgcagcttcacaatttatctctgggcctgtttctctgaaattctaaataccaggacttgcttaaaaagcttgcatttttgaactctggtttgctgaagaccagaatgttaaatgtcacattgaaatggaaaaaaaaatcaaggccagtaagatagaagggctctttgcttttcacattgtttatcatgtttcttcctgttgtaaatgatttgctttttaggtgtgtcttcactgggatttatatttttgaagctttgattaaaatattggcaagaggtttcattctggatgagttttctttccttcgagatccatggaactggctggactccattgtcattggaatagcgtaagaatattaaagatgtttttgaagagacttggagtgggaaagaagcccctttgcttccatcagagctctgtgtggatccatttgagtggctgagtatggcctagtaatgcctagagctctgagtgctgtgttggttggccctgaacagcacgtgcagccaattggccagaggcccccacacacaaagccatttctaggtcaacactcaagttcgtgttccttcagccatttactcaccaacactggcctgttatgggccaggctctatggaagatacaggggtgtgccaatgaaattaaaaaaaaaaaaaaagacatggttttcaatcttatgaagctcacagtccagaggggaaaagtaacaattaatggccctgaaaatatggtatgatgagtaccaggataggggctatacatgtattaagctgtcagagaatataggaagaacaaagcagtctaaaaaatctttggctgctacaaggttacaaagagctttactcctgtttacttctagaagttctgtagttttggcttttatgtttcagtccatggtccattttgagttaattatcatgtatggtgtaaggtgaaggttgaagctcttcctgaaggaaagacactgatttggaatctgaatgatgaaatggagtcagcaaaagaaaaaataagaaatgcagtgacacattgccagcacaacaatagtaaacctggcatcattcaatatgtaccaggcattatgttaagcactttgcatattttttcctatttaatattcacaaaagcccttggaggtaggtgctagtaatttcagagttttacatttgaagttcaaagattgtgtgctcttcgttattgaaaggtggtgaagcacagtggtttagagtatggctctggagctacactgcctggctacacattcaggcttgaccatgtagtggcaggagactttagtgaagtgccttggggcatggaacttgtcagccactcagtaaatatttgagaggacttctattattcatggatgtagccacaactacatgaactatttcaaggagtcttcatctgtgtccacgtatgaaggtgaactgagaacagcgtcctctgcagttcatagcaagaacagtggtattgccagatcctaagataaaggtggggctggaaaggtgaggctgtcgatttcaccttggaggtcacaggcctcaggctgagcttacttgtggcttttgtggagatgtgcagtgcagctgcaggactgagcaagcccatgccttccctgtgctttgtcttgtaggattgtgtcatatattccaggaatcaccatcaaactattgcccctgcgtaccttccgtgtgttcagagctttgaaagcaatttcagtagtttcacgtaagtcactctcactttccacactggctcctatctagaaagaatgttaatttatatttaaattttttcaaaatgtcatcatgtaaaccaaaaacaaacaaagcctgctttacaaatttatttgatggtccaactgataattattgagcacctaatatgtccaggcactgtgctaactgcttgagatctagtagtaagcaaatggatacggactcatggagttttaccttctatggtgggggtggggagacagacacgaagcaacaactataataaataagtacattatgtagcatgtgagcaagtgctatgtgccagggaaaatataaagaaaaagtagacaccatgagggctatgggaagtcacagggtacaggggaaggaggttgcagttttaaacagagtgatcacgatagttgtcattgaggtgagaggtggcagagatttgaaggtggcaagggagtgacacaagcagatatatgggaaagagtattctgagcatgggaaacagccagcacagagattgaggagtagcaaggatgaggatgggactggaaaggagagggtgagaggccaggtagaggtgggatcatagaagtgaagggggggccgggtacagttgctcacgccagtaattctagcactttgggaggccaaggtggggagataacttgaggccaggagtttcagaacagcctggccaatatggaaaagcctcgtctctacaaaaatacaagagttaaggccaggtgcagtggctcactcctgtaatcccaacactttggaaggctgaggcaggtggatcacctgaggtcagaagtttggtatcagcctgatcaacatggagaaaccccatctctactaaaaatacaaaagtaatcaggtgtggtggtgcatgcctgtaatcccagctactcaggaggctgaggtgggagaatcacttgaacctgggagagggaggttgcggtgagcctggatcgccccattgcactccagcctgggcaacaaaagcaaaactgtctcagaaaaaaaaaaaattagttagatgtggtggtgagtacctttaatctcagctactcgagaagctgaggcaggagaattgcttgaacctgggaggcagaggctgcaggctgcagtgagccaagattgtgccattgcactccagcctaaggtctaaaaaaaaaaaaggactgaaggggagtcttgtaggcacagggaggatatgcgcttcactctgaagaaatgggagctgttgtgtggagaatggaatgtaggggagatgggagaagcaggaagacctcctgctacagggagcacagtggactaaagatcccggcttccacctctctggattccccactgcattcatccacatgccaagatcatgcctgccctgcacagtgtgtgtgggttctagtgctggcccattcctgaagcatatgggattcttctaataggaaactttggctcagggactctccagtgacctggctgagactccgacagctgcactgcagtctgaggttcttcctatccaatcctcctcccttgtctgtctctcagacatcaaacttgagctgcagtctgaagtttctccctgcccactcctgctcccccgactcatctttcacaggcgtcctcccaacccccacaaatctctggcacatctgatctcagaatgtctgctcctcaaaacccaaactgacacaagagaccataatccaagcaagggatggcagtgctctctgatcaggtagtggtagtggagttggtagacactggtttgattctgtgtcaattcaaaggtagaaacaatagcatttcctgactgatcaattgtatacatggtgtgagcaaaagagaggagtcaaaaatgacttttatacctgatgtcactgattgagacagagaaggctgtgagaggagcaggccttggggtcagattacaagctagctttgaacatgttatgtttgagatggctgtgagaccaccaagggaaaggattcagcaggaaattaggtatatatgagtccaggagtccagggagaagtcagagctagagataccatttcaggaatcaagggtctatagatatttaaagccgtgagatctaaagagatcaccaagggaataagcactgatggagaatagaagaggaccaaggtctgagccccagggtactgaaacatgaaagggagaagaggagaaaccagggaaggagatgagcagcagccacctgtgaagtaggaggggaaccaaaggtggtctcctggaagccaggtgaggaagtcatgttagcccttcggatcaggatgaagccaaggttgggtgtgaatatgaatttctgtttattaaaaatgaggttattatagcacacccttttcctctccttcccctttcctctcttttctttactaaaacaaacaaacaaaacagtttattatcttccctctctggactcctttccccccaccttctccccttcccttcttttctcttctatcagtggctttggcaaactgtaaaaagacatgggaactatttagttgtgctgatgatatagacataaactataccgcatggccccaatacctaaactccagtcctttcaaacagaagcagtaggttattttttgaaacttcagaaaagcaactgaatagtgataaagaaactggtagtcagaggacactttatatacaatttatctcttcttctcctcctcctcctcctcctccttctccttcttcttttcaagtaggactttgttttcccaggtagatttaggagctttctgcatgagctgagccccttttattttcacataagtaaatacacattcaggcagtcatttagcagctttcatgtccccgtcttcatctccacacaggtgaatatagtctctattttggcccattaaatgcactgagatgcctggatgctttttggaagtaagggtgtgaggcacaatcttttatgagactattaaaaaatgatccaggaatcacaatcatcactcatccacatttcttgctttggagaagcctcttgttatagattaaaatctgccttgggtgacactgtagtaacctctggtttgccttcaattggtgatatagtaagtgtcccagcttggcctccaggttcctgctatctggtgttatactttgtgggaagcccatccactgagggcttggcctcccactgtatgctgccatgtgctctcacctctatgctaatcaattgaaattttgtcacttagtgtcattccatgcctttcaattacatctgggagtttatctctccagctatcttgagactcagtggattgctgaagttgacttgttctttttccagctctgtccagtgacatcatattggtagcttgaaatctaccatggtggtgagtggggatcaggatctataccacagaattcagaaaacaaggaaacctgtaaatgctatagatcagggctctcctgcctcctgcttgaagagccagttttaaatatttactagcatgccacaagattatttattttgtaactttggcagcttaacagtgtgccatggacatagtaggtgcttaataaatacttcttgaatgaatgaatgaatgaaaagaaaacaccctattctaactggtaatctgagttttccctcccaggatatcctcataatttgggtctagacaaatctccttcatcccctataccccacaatttagctgtgtctcatggtactcaagtactttgacagtagacagtatctactaaatgttaaatacaggtctatctcattctctagtgtggccccagcttaggtggtgcctttgcaactgtcctcaacctatgccttgagtccgtgtggcatgtttctattcaaagcctctttgcttgctcctcatagcagcactgaggcaggcatagggcaggaatagagagattgagtctcaaacttgttgactgctttgatgacactcagcttccaaggcacagagttggagcacaaactcaaggcatcagaatcataggctaggctggagtccagttccagcctgcaatttgacagtttccgagacttcagttgctccttacttggcctttgtgagtgtctggctgagggggatgggcttctccccaagcctgtcctctttctcaggtctgaaggtcatcgtgggggccttgctacgctctgtgaagaagctggtcaacgtgattatcctcaccttcttttgcctcagcatctttgccctggtaggtcagcagctcttcatgggaagtctgaacctgaaatgcatctcgagggactgtaaaaatatcagtaacccggaagcttatggtaaatacccaacctttctttcactccttggtttttgcatggttaacttttccttatcctcacttgtcctgccttcacacttcccttacagagtctcttagcagcaagggaggacttcatccatccagggtgctcctgtgggcagatgcatttcctagagaattgcctcattctttggcttcctatggagaaggaaagtcttgaaaccacatccacaagagcaattctatgctgtcccatccctttgccatttagatctctgcccacttctttgtaatgatttgcagaagtttttagaatgcttggatttggctaacaataatcagcagcttcccagccccactcctcaagtatttctccaatgacacgtcttttttttttttttttttttgagatggagtctagctctgtcaccaggccggagtgcagtgacatcaccccactgcaacctctgcctcccaggttcaagtgattctcctgcctcagcctctcaagtagctgggattacaggcatgtgccgccacacccagctaatttttgtatttttagtagagacgaggtttcaccatgttggccaggatgatctccatctcctgacctcgtgatctgcccacctcagcctcccaaagtgctgggattacaggcgtgagccaccatgcccggccaacaacacttctttcagtgcccaccctctccatgctgaggttgaccctacacctactccatgtgtcatgaatctcatgtgactacactctcttgatgtctctcatgggatgggtctgtgtccagcttcccccagggaggatcttcggttcagtattatttaagagaggcaaagtggtggtggtgatgtcactgcttcctcctccaacttctccttccttcttcttttccctccttccttcttactccttccagaggtcttgggctccagtttctctctggacacacctcctttaatcattttagaagatgtagaaacatccattttcaagcataatctgcatacttactattctctttcctttcaatgttttttttaaaatctgaatttatgactttttcctctctcagaccattgctttgaaaagaaagaaaattcacctgaattcaaaatgtgtggcatctggatgggtaacaggtaagaggtttataatcattttcctcccaagaagagtacctctagaccttttagaatggtgtggcaaacagtctttaatgactggtggacacagtgatgatagttctcacataattatttcatgtgtctaaacatgtttagacttgtgttattaaattaaaaaatcatttcctggtgtttaaggcagctttcctccctagttatgttaaattggaagcttataagaaacctactgaaacagtgatatttcaactttatggagtaggtattcaagactttcaaaactgagaagggatgttatgactgagagccctgtgaggcccttgtttcctgttcagtggcattgccctgctgcaagagtatctgagcatgcttcttctctttgttgacctgttgacaactattgcctcaaattacaaacacagttgaacatacatccacttacacttgccccaacagctgctggccctctgctccaatggggaaactcttttttccttcaggttagcggtgctttctattgtgaaagattcaattcagtgaagatttattgagtgtatttcaaattaagataatatgcaaggtactctgatgaaatagatgacattcattcctaaattacaaatagataacaagaatctacagagtgccaagccctgagtttgcctcaaggaatgcaattgtgaacaaggcagctccacgtttttggatttgatgtcttctagggaagacagatgcacagaaaatgcagttatgtgttgcataatgatatttagattgataatggatgatatatatgatactggccccataaaattataatactatatttttacagtgccttttctgtgtatacacaaattattaccattgtgctacagttgcctacagtattcagtatagtaacatgctgtacaagtttgtagcctaggaacaataggctatgccacatagtctaggtgtgtagtaggctataccatctaggcttgtgtgtacactctatgatgtttatacaacaaaattgcctaactacacatttcttagaatgtattcctgctgttgagcaatgcatgattactagaaagtgtgatgagtgttataagggtgatgtgcaggtgctgagaggtatgatggggttgtgaccttgtctggagaattagggaaggcttctctcattccatttgcaagacacgataggctttaatctaatatgaagcttactgagctttctagaatgattcccaacagcacacactgcattgatattgttgaggatcattctagaaagaaaaactgtcttccatgaaaccggtccctgttgccagaaagctccccaacattttggcaccagggactgatttcatggaagataattttttcgtgggcaggaagtgggggtggttttagaatgaaactgttctacctcagatcatcaggcattagttagattctcataaggagcgtgcaacctagatcccttgcatgcgcagttcacaatagggttcacactcttatgaaaatctaatgcttaccactgatgtgacaggaggtggagatcaggtgtaatgctcactcgcctgctgctcacttgctgtacagcctagttcctagcaggccatgaaccagtactgctctggggcccgggtttggggatccctgtcttaaagggagcccgacagctgctgcatatagcacttcttttacccctcacacaggcagacaggtgtggttaccataggcagaatccaacgtggggtgtataacctagacaggcagaagcagcagccttgtttccaactagtcctttttttttttcccaagtcttttgcctccaaaatctcttattacaatactatactgctataaaaagtccaaaaaactattttagctgttgaaaactcaaataacatcagacacaaaatgaatcaagtgtgatgtgtatatgacaatagagagtggtggggaaagtagagaggcagaggacacataccatgcttaacagcagtcaaacttgggtattttttttatttcagtaggttttgggggaacaggtggtacttggttacatgaataagttctttagtggtaatttctgagattttggtgcacaaactggtcttctttttagcttttattttaagttcaggggtacatatgcaggtttgttatataggtaaatttgtgtacagattatttcatcacccaggtattaaatctagtacccattagttatttttcctgattctcttccttctctcaacctccaccatccaataggtcccagtatctattgttctccactgtgtgtccatgtgttctcatcatttatctctcatttacaactaagaacatgtaggatttggtttttctgttcttgcattagtttgttaaggttaatagcctccagctccatccatgttcttgcaaagtaatagaactcattctttttatggctgcatagtattccatggcacatatgcaccacattagctttatccagtctgtcattgttgggcattcaggttgcctccatgtctttgctcttgtgaatagtgtgacaatgaactttcacttgcatgtgtctttatgatacaatgatttatattcctttgggtatatacccagtaatgggcttgccaggtcaaatggtagttctgtttttaggtctttgaggaattgccacagttttccacaatggttgaactaatttacactcccaccaacggtggataaatgttcctttttctccgcatccatgccagcatctgttattttttgactttttagtaatagccattctgactggtgtgagatggtatctcattgtggttttgatttgtatttctctaatgatcaatgatgtacaactggtctttatagggctcttgtctctaagtttatgtgccagcacatctctctcagtctaggtacaatatgaatgctccagagttttgtggtaaaccaactcctagtacacagcattccacagtgatcacaacatgcttgcttctgaggagatggcactctgagaaggcaggtctgtgatcatctttccaggcaggctttggtcttttcagggcccaggctagtcttcaccctccagtcactgcttcctcccctgctgactaattcaccgtgactacaactcagatctgaagtctaagtaggaggttccagtagataaagagtgaacaattccagacagtaggcacagcaagggtgagcataaggccttggagcacaagagcatatagggattgacaagaagcccagcaactttttgggcagacaggcaagagagcaggaaggaacagagacaagagccaaccatgaaggacgtgatagctcatcagtgccaacgattttggtcttgatcacaaaggaagcaggagacatggaaaggttttagggcaggcagatgactgggcagattagacatattttaaaagccactatggtttctgtatagagaatggatgcatagagtagatgaggaagccaattacaagactgtggtagaaagaataaggatcatgaagatgtacagtggtgatgaagaaagctggatggatgcattccagagacgtttaggagacagaaagactaggacatatcaatattagccttgaatgtcaatgggctaaatgccccacttaaaaggcacacaatggcaagctggataaaaaagcaagacccaatggtatgctgtcttcaaaagactcatcttacatgtaatgacacacataggctcaaaataaaagaaatggaggaaaatataccaagcaaatggaaatcagaaaaaaagcagaagttgcaatcttaatttcagacaaaacagactttaaaccaacaaagataaaaaatagataaagaagggcattacataatggtaaaatgttcaattcaacaagaagacctaactaatctaaaggtatatgcgcccaagacaggagcacccagattcaaaaggcaagttcttagagacctacaaagagacttagactcccacacaataatagtgggagacttcaacacagcactgacagtattagacagatcactggggcagaaaattaaccaagatattcaggacctgaagtcaacattggaccaaatggacctgttagacctctacagaactctccaccccaaaacaacagaatatacattcttctcatcaccacatggcccatactctaaaactgaccacataatggaacataaaacaagcttcagcaaatgcaaaagaaccaaaattttaccaaacacactctcggaccacagcacaataaaaatagaagaaaagactaaaaaaatcacttaaaaccatgcaattacatggaaattaaacaacatgcctctgaatgacttttgggtaaataatgaaattaaagcagaaatcaagaagttttttggaactaatgagaacaaagatacaacataccagaatctctgggacacagctaaggcagtgttaagagaaaattcatagcactaaacgcccacatcaaaaacttagaaataacttaaacaatgtcacatcacaatggaaagagttagagaagcaagagcaaagctagcagaagacaaaaaataaggaaatccaaataaacacaattagaaataacaaaggggatgttaccactgaccccacagaaataaaaataaccattaaaaactgctaaaaacacctctaagcacacaaactaaaaatacctggacacaaacaccctgccaagactgaactgggaagaaactgattccctgaatagaccaataacaagctccaaaattgaatctataataaatagcctaccaaccaaaaaaatcctgagaccagatggatccatagctgaattctactagatgtacaaagagcaggtaccattcctacagaaactattccaaaaaattgaggagcagagactcctccccaaatcattcaatgagaccaccatcgtcctgataccaaaacctggcagaggcacaaaaaaagaaaactttaggtcaatatccttgatgaacattgatgcaaaaatcctcaacaaaatacttgcaaacctaatccagcagcacattaaaaagctaatccaccacaatcaagtaggcttcatccttgggatgcatggttggttcaacatatgcaaatcaataaatgtgattcatcagaactaaagtaaaaaaacacatgaatatttcaatagttgcagaaaaggcttttgataaactcaacatccattcatgttcaaaactctcaatacactagatattgaaggaacatacctcaaaataataagagccatctatgacaaacctacagccaacatcatactgaatggggaaaagctggaagcattctccttgaaaagtagcacaagacaggataccctctctcaccactcctattcaacatagtattgggagtcctggacagagcaatcaggaagaaaaagaaataaagggcatccaaataggaagagaagaagtcaaactattcctgtttgcagataacatgaatctatatctagaaaaccccataatctcagctcaaaagctccttcagctgataaacaacttcagcaaagtttcaagacacaaaatcaatgtacgaaaaccactagcattcctgtataccaacagccaagccgagagccaaatcaggaatgcaatcctatttactattgtgacaaaataataaaatacataggaatacagccaacagggaggtgaaagatctctacaatgagaattgcaaaatgctgctcaaagaaattaaaaatgacacaaacaaatggaagaacatctcatgctcatggataggaagaatcaatatcattaaaatggatatactgcctagagcaatttacagattcagtgctattcctatgaaattaccaatgacattcttgacagaatttaaaaaatgctgttttaaaatttatatggaatcaagaaagagcccaaatacccaaggcaatcctaagtaaaaagtataaagctggaggcatcacgtttcccaacttcaaaatatacaacagggctacagtaaccaaaacagcatggtactgatacaaaaacagtcatatagatcaatgtacagaatagagagcccagaaataaggctgcacacctacaaccatctgatcttgaacaaagctgacaaaacaagcaatgaggaaaacaccctattcaataaatggtgctggaataactggctagctatatgcagaagattgaaactggactcctttcttacaccatatacaaaaatcaactcaagatggattaaagacttaaatgtaaatccccaaactataaaaactctggaagacaacctatgcaataccattctggacatagaaatgggcaaatatttcatgatgaagatgccaaaagcaatcagaatgaaaccaaaatttgacaaatgggatctaactaaacttaagagcttctgcacagaaaacaaaaacaaacaaaaaccaaaaaactattaacagagtaaacagacaacctacagaatgggagaaaatatttgcaaactatgcatctgttaaaggtctgatattcagcatctataaggaaattaaatttacaataagaaaacaactccactgaaaagtgggcaaaggacatgaatagactttttttttaaagaagacttacatgcagccaacgagcatatgataaaaagctcaacatcactgaccattagacaaatgcaaatcagaaccacaataaggtactatttcacaccagtcagaatggctatcattagagtcaaaaaataacagacgctggcaatgttgtggagaaaagggaacacatacactgttagtagaagtgtaaattagttcaaccattatggaaagcagtgtggcaattcctcaaagacctaaaacagaactactgttgctggattcatcccagcaatcgcattactgggtaggtacccagaggaatataaatcattctactgtaaagatacacacacatgcatgttcattgcagcactgttcactatagcaaagacatggaagcaacctgaatgcctatcagtgacaaactggataaagaaaatgtggtacacatacatgatggaatactatgcagccataaaaaagcaagagattatgtcttttgcgggagcatggatggagttagaggccattagccttagcaaactaaagcaggaaacagaaaaccaaatactgcatgttctcacttgtaagtgggagttaaatgatgagaactcacggacatagaaaagaacaacagctactgggacctacttgaggatgaagggtaggagcagcaagaggagcagaaaaaataactgttgggtactaggcttagtacctaggtgatgaaataatctgtacaacaagcccctgtgacatgagtttacctatataacaaacctgcacatgtacgccagaacctaaaataataggtaaaaataaataaatagaaagaaaaaaatttggagattgaagaggggatgttggtgtgtatttgtgcatacaaagccatgtgtaagagagtggcgggaagtgcaaaggagagaaaactgttacagatgcttctcatatcagtgtgagtgagtgataatgtcattagctgagatggggatgctggcggagaggcttaatcacctgtataagttgatgagagggtgcacccagagaggaggagattgaacaaaacaggcttatattttgaatggtgaccaagaaatgagggagattaaatatggtaggtccatcctcagcagactcctggaagttagagggcactgggacttcacagaatttcctccaggtctggtgagaaagagggcacaatggatgccctcctcctcagtcaacctaaagcaaaacctaccactcacaaattcccactctgcccaccaggcaaatcccaatcagcttgtcaggtcctctgattaaaacacatgaacagctcaggctcaccaggcatctgaagaaaatctttggtaaaaaggaggccaagataaagccacagaaaatgtggccatgaacaaaacaagagaaccagaaagggctctgaaaactttgaatagtgtccttggtgaaattaaaagagatattatatacataaaacaaaaagcagcttgttgtgaaaaaagaacagcaaaaaaagaaacttattagaaattaaacattattacacaaaaatcaacattagaactaaaagataaagttgacgaaatagccccgaaagtaggaaaaagagaacagaaaatttgagagtaaatgtcaattcaaaagtcccaacttttgactaagtaggaattctacaactagagcactgattaaacaaaagggaggaaattagtgaagaaatgatgcagagaatttacctgggactaaagatgcaagtccctcagtgctccagaaagtacccaacacagtgaatgagaaaggaccatgccaaggacattatcatggcatttcagaactttttggaaaaagattttaaaactaatgggcaaaagaaggtcacccaaaaaggaacaaaaatcaaactggcataagaattcttaatagcaacacaggataataactgagcagtgctttcatattgctaaggaaaaacttccaactcagaattctatttctggccaaactaccaattgattgtgaaaatggaataaatatatattcatatatgcaaagattacacaatcttcttaagaagctaattgacaagtgctccagaagaatgagggagtaaaacataaaaaagcaacatgaaaaagccaagaaaaaatgtctaccatagcaagaagttaatcaacacgaactacaattgataaatcaaatatcagtgtaagcactatttagatatacggaggtagaagagttaacagttgttgaatttggggtgtataaatgacagttaaagaattatacaattgatttcattataagctttttggtgcatgtaatttttaagccatgtgcatgtattactttgattaaaatactatttattaaaaaactaagaaatacatacccttagtacatcttatagatacactcaataatttgtgttttggtaatatgtgaaaagacctatgttcaaagatattcattgcccaaatgtttgtaagagtgaaggactgtcaattactgaaacctaaatattcatcattagcagagcagttaaataaatcatagaactatagacatgaaaagaaataagatatctccctgtatggtgatatgaaaagagctctgaactatattgttccattaaaaaaagcaaggtgcaggagagtgcaaagcatgttcccatttttgtgtattataaaagttgtgtgtagatatagatgtgctgtatagtcatagcaaacttctggaaatttacaaaagtaactgttaactattgcctctaagaagtgggatcaggaaactgggaagagaggaagacttaatattcattgtatgtgcttttatactattcattgttcacgtgtcactgtactcaatttttcaatgaaaaactatcttatatgaatttattaatcagttcattagcaaaagagtcttgtcagacagtgcagtgggccactttacaaatactcccttcctctagggctcctggtgtgatcccacagcccttggaaaaaccagagtcgttggaaggaaaaagaagcttggctgtggcgtacataattatttctctgtttgtttccaatatctagtgcctgttccatacaatatgaatgtaagcacaccaaaattaatcctgactataattatacgaattttgacaactttggctggtcttttcttgccatgttccggctgatgacccaagattcctgggagaagctttatcaacaggttatctatttatagtctctctttttcctctctccctccctccatccttttccttccccctctatcacttacctatttatttaccatttatttataactaccattcatcccccacttttatcatctgtctcatctttaacagttgtactgttaaattctgccttactaattctgttagaaacttcaagaaaattggccaggcacgctgactcccgcctgtaatcctagcactttggaaggctgaggcttgaggtcaggagtttgagaccagcctggccaacatggtgaaaccccaactctactaaaaatacaaaaattagcagggcatggtgacaggtgcctgtaatccccactacttggaaagatgaggcaggagaatcacttgaacctaggaggcggaggttgcaatgagccgagatcacaccactgcactccagcctgggtgatagagtgaaactccgtctcaaaaaaaaaaaaaaaaagaaacttcaagaaaattttaaatgcaatatttggaagaagactccaaagaacccctcctcttcctagaaatgttagccccctccagattccctactgccctatctctcttgccacttttattttaaaaatgcagatactcttgagagagttatagatagtaaagtcactgaaacttccatgtgaaggtgtggatagtatctccccactgagagatagggcatcaggaatccctggagtattagggaagctatatggtctgtggtcaactgagcccaccagtgctgggggaagaccagttgtctgctactgtgtggtttttgcttgaggtgatggtcactttcctgtggaagaaggtttgatattcaagaacatgctctgtcctttgcagaccctgcgtactactgggctctactcagtcttcttcttcattgtggtcattttcctgggctccttctacctgattaacttaaccctggctgttgttaccatggcatatgaggagcagaacaagaatgtagctgcagagatagaggccaaggaaaagatgtttcaggaagcccagcagctgttaaaggaggaaaaggaggtagggacatggggtcagacagtgggatctgctctggggaggggaaggggtccccagaggcaatgtgacctgagactcaaggctgccacccttggcctggtctcagtgctttctctactggtgcttttctgagaatataagtccctcgaagaatggctgtgctgctatctttcacaaaattgtccaggcaccaggcccttcaaaacggggaacgcttggtcttgatgctttttgaccttctgaagtctaagccttctaagacatgccctaaattactgactagacgatacaacataagtatatgtaaatccaggctgtgctccaggctttcttttggaaatctggagatgtttgtgttcggcgcctttgcttgaggtggactctagaataatgttcacctctccctgtctgcaatccttgtcttatttataggccattctaatagtttccttggaatctttacattcttccagctcaagtctcagattttcaggacagggaccatgttttatactcgcactgatcctctataagatttgtcagaaggatgcccatcgtaagtgcttaacatctgcactatcaggcataagtatttattgagtgcctagcgcatactggacactgtgctaaggggcagtgacacagagatatgaaagagtcaatgctgcttttggtggctgcaatttctgtgcaaaaacaggacatgtttccccagataaataacagagctagcgtagtccaggtagatgatgagcaatttaaatgatacagagctaccagaagagagattttcaccactctcaggtcggggtcatttgcaatgtttcatgaggaggtgtaatctgttctttaattgcttttgttcaatttgaaggctctggttgccatgggaattgacagaagttcacttacttcccttgaaacatcatattttaccccaaaaaagagaaagctctttggtaataagaaaaggaagtccttctttttgagagagtctgggaaagaccagcctcctgggtcagattctgatgaagattgccaaaaaaaggtaagtcttttccagggaattaatgataccatattgctgtccagggggacaggtccaattgccaatcaaattgaaataattcatttattcagttactcatttattcattcatccatttgcacatactttcatgcatccatgtgtcttttcaattatccatttatttgtaaacatcaatttagagtgtttacagtgtttactatcttcttggcactgggataggtgctagggatacatgttttatactccacagagtgtacggctaatgatgaagatatactgataagaaggcagttatgagtcagtgtgatgactgatgtgctgattgctgtgggagaacagaggaggaactatgtgtcagtgtgggctccctctgaagcaaacccaaagacattacaatgcaagtagattatttgggaagtgatcccaggaagcactgggaaaggagggaagaagtgctatatggaatggaaggtaaccaatgaagatgcattatcaagccagttaccactgaagccaggtagttggagtttaatccttccaaagtaagggcatcaaagtgtgtgtgtgtgtgtgtgtgtgtgtgtgtgtatatatagatatatacacacacacacacacacacacacacacacacatatatgttggtatatatataccaactttggaccatcatagattaaagattgctgaagacagaagacaataatttccctctaatttcctacttgctgtgcactaaggaagacaggatttgaatcattagagaaagtcctcaagtaaggacatatgggtgggaaaaccaacagcatccagaattcatggggcctgggggaaaagcaatggaaaagggtccccagaagatgcagtgtgtcagctgaaaggatgaattcaccagtaaaaggaaaaagagagcattacctgcagagagaatagaatgtgcaaaagcctagaagcgaaggcaagcaggagaacatgacccattagaaaacttgccagtgtgtgtgtatgcgcgtgcacgcacgctcatgcatgcacatgtgtgatgaggctgggggagggtgggtggcacaaggctatagtgatcagttgggggatcacaaaagacctcgaaaacaaagctagagagtttacccttttcaatgagggctaagggtaaagagcattgaaaggtttatataagagagggatatgactggatttatgaaattctggatgcattgaagacaggggattggaggagggcaaaactggaggcgaccagttaagaggctgttgcagtaaccaagtaagaggtgcctgtggcttaaaccagggttagggaagtgaggatgaagagcaattaacagacgaccgtgatctggagaagataaaatttagcagttgacttgatggacagtgtggggataagacctggtttccgacatgattagctaacttgatggagggtaatttatggagacaggaaaggtacacattttgggagtggaaagatggctcattcagttttgaatgtgccaatttccagatgcttatgggacctccaagcagggatgttgattaggcagcgtgatgtgcagaaatgaagctggtggtgggggagggatgggcagcagaaaaagttattcttatcattaaggagggggatgttcagacatattttaattgtccagagaaaagtcagaagagaggaagatgctaaagatacaggtaaagatggcaagagccactttcctgagatagagggagatgtagtaggtagaaggtggatatgtatgcctgataatgtggtggggaaagggaattgagaggcctttgcagaagtaggtagaaggatcccatccactgctatgatcagttctctgctgtagtaatagggagagatctcatagaaagactatctagattggcttatcacaaaaaagatagttccctctggggctctggtgagtcggaacccttggaaaataagccactaggaaaacccaaattttctggatagctggaggtttgcactgtttaattccagtaactttagaattgtaggtagatgtgagagagtgagctagcccttgggcccagcttgagagtgtgtttgaggtttaggatctagattttgtgatatttagtgggactgttctttttagttaccaaccgttttaaaaaccgtataggcggttgttcacttcacaactgcagctagcacttcacaatctggctccagtccacctttctaaatttatactccacttcttacctttaaacattgtttacaaattggattttgtattgctttcatacccggaaccattgcttactagtttttgtaaaattttgtttgctctttgttggcagtgaatgaaacacagagaaagtaaaatgtctgtaggtaggactctagaaatgtgcatgcataggaaatatgaatgatcaaaccagatttctcttatttgttaaacatgaaataagaaaactgaatatttggcatgctgtaaagacgaggtgagtagacctatagaaaatgttgagcactttcattacatgtagcattggaacaaagtagtttgttaagttttgaggagaggcagcccctgtctttagaaggtgccctatgccttctcttacagccacagctcctagagcaaaccaaacgactgtcccagaatctatcactggaccactttgatgagcatggagatcctctccaaaggcagagagcactgagtgctgtcagcatcctcaccatcaccatgaagggtaagttccacatcccaatccaagggaaagtctacttcagtgatgtccttccattcttcttcttcccaatcccctagaagccctctgcaaaggaggctgttttggaaccaacccactgtaccatcctgcaaagagtgacttcctttgcctctttggagcatgtaaacaaagtggctcacaagaagcagaccttccctgtgggcccactctaaactggcacctgggtagaggtggaagctggctagacttgggatgggacttcagacaaaatgcataaacagggcctcaaaccaggcctgggagtcacaagagatccaagtgacaacaatagtcagtcaaagaacagaagactttgaagtctccaggaggtggcagttgttattgaagttagagtcagaaaccccacatgggcaatagaagacctatgtagaaaggctggagccatctgatggaccagattaatagcaggtaacaggaccccaccccaggggttggtgttcaggagcaggatttactccctgcaaggggggtcaaataggtcctctagcacttttaagcctactgcatcatctcgtttgccctgcatgtgtccctgcagcggtgccagggaaatcagggatggtctgaactcaactagaggatagagtcccttttactgtttcagtgcttatagatgccccttcccttgagccctggttgccccttttgcctctgttacagctgaccttatggtctgtcttgagtggacataacttgtgcctgtatctatctctctcttggattcacagccagccaatgttgatttccacatctatatatctaacatcaaagctcagctcctggatgctcagtaagagtgtaaatatttgatggacttgactgtaccgcatgctagttgtatgtggaacattgtctcttctgcactaagattggtggaaaaacctttctgactacacaaatcaaaacatttcacaactgatcatgtatcaggaggccctggggaagagggaggaaggaatgcactcaggcaaagggcatctggattgcttcagagctaactcctcaacctctcgctcattctcctccagaacaagaaaaatcacaagagccttgtctcccttgtggagaaaacctggcatccaagtacctcgtgtggaactgttgcccccagtggctgtgcgttaagaaggtcctgagaactgtgatgactgacccgtttactgagctggccatcaccatctgcatcatcatcaacactgtcttcttggccatggagcatcacaagatggaggccagttttgagaagatgttgaatatagggaatttggtaacattacactttttaaaaataaaaaacatatttcatactttaaagtataactttttcaaagtctaaacattttgtgaatgagctaacctaacctaggtttttggtccccttcagtggagtgagggaaaagatggctgttacggttttacttttacccggttcatttcagaaactgtccatgtgtcctgagttggccctctggtatgttcaggtatctctttagccattcagtggtaagccagatacaagcagacatcctaaaagttcagctctctgagataatcaagaaaatgttaaccatatccagagaaccgtggtaatggctgttgtggtcccagtgatattcatgacatcatttgtcacaaaataatgtgactactattactaggtgttattctccctggaaagatgaatcagggcctgtcagctgtggaagtttcacttttttggaaggggttgtttgggggttggtcaggctggggtggggtgaatttccagacttgagcctgcttcaatatgtttctcattggatagatctagtctcagttaaattgggaaaactaaggggagcagacttttcaaggactgttcacttcagtttatggttcttgtggaaggcatttttctcaaggaaaaattagtccctcgaatatcagaaacaacaaataattgcccacgggatgatctaccctaattagctgatggattaatgagctaaaaaccttaccagaatgtctagccttttcttcttaaacttttgttttatctttctaatttaaaaaataataaatgctgttttattttttaaaaataaggaaaaatataaataagggaaatagaagaaattcatgtcccatgtacctgctgacaaagatgatcatttttagcattgcagaatatttgcaagctttatgtaagcatgtatgtatgtgtgtatgtatttttatttagtgttattttttctccttttttggcatttttttttttgtgatgtctttttacatgtctttaaaaaatttgttttacattgttaagaacccactgcagccgagcacagtggctcacgcctgtaatcccaacactttgggaggccgaggcaggcagatcatgaggtcaggagatcaagaccatcctggctaacacggtgaaaccccatctctactaaaaatacaaaaatttagccgggcatggtggcaggcgcctgtagtcccaactactcaggaggctgaggctggagaatggtgtgaaccagggaggcggatcttgcagtgagccgagatcgtgccactgcactccagcctgggtgacaaagtgagactccatctcaaaaaaaaaaaaagaacccactgcactagagtcaggtacctgtcatccttagttccacatccctccacaaggagcagtgatacagtggaactgtagtataaaaccagggtggttctcctcacaggcagtctgcacatagcacataaattcctttctccatgctgcctttgggaataaatgctttgtgggtgtgaatgggttagactagattccatgctgcttgacaaacctaacacatagttgcttgtaacagatcagggtctcctggccatgtattcagctatcctctgctgaggcatctcagaaatgagctgaaattgtttcagttgaaggcagcaagctgtgtctataggggcatggtcagcagactccaccttttagcacctcctggtggaatggagttactgaataagttgtagagaatactcaaaaacccagagtcatctctgtggacagggcttcccaattgcagtggtgatctgttttcatctgctggtccaaatttagaaaatgagaaaaacccccatctcagatttaccactgactagacatcctgagtgtggaggtgaagctacattttgcagttggaaactgagtgattgacattcttcttcacttcctccagagcaggaggagccacagggccacagggacattgttgttttccaagtacacaggcagcagctgcaccctagctcctaaaaattggcaggaaatatgtagaaccatacacatagcttgtgtttccattccatgggcctactccctggacatacaataccaaaatggcagccacactatttactgctcccatggtagtagtggtggagagaagccttggagtcttaagttccaaggagcacatcaaaacttccctcctctgatgcatgggccaggattaagccactctgtagagttctgcaggactggactagaaaattaactctctagggtagagattgctctaatcagagggatacactgaatgccaagaagccataaagaaaagttggattgaattgacaaaacaatggtcccaaggtatctggtgatgctgtagagcttgatgcctaaagcctaaaggagatacaagaaggaggagtgagtcaaaagaggtggggatgactacacaattatctaggacaggcatcactgtatgcttttagatactggtggtgacactgagcaggagtagatggcagtatttaaagggggaatatgaaaataaacttgaattttctttgtaactcttgatttatttttatttttctaccctggatttatctttgctatccttttgtctttaacttttgccattttatttcaggcatttttaaaaataaatagtaaatcattgaatcatttataaaaatagataatccattatttttaataatcgaatttagtcgtttataggttccccccagaattgtagtagacagttttataacaatccttgtaaagactttaatccttttaatattaccttattatttttgtattcttgcttttttcatttctatttatttgtgtttgtatgtgataagactgtgctgtttgccgtgaagaaattatttgctttattttttgcaaagatatggaagacagatttattttttaattggctactacattcaacatttttacatatttcttaagcttgtatttatctgattattgaagacaaagacaaaactattttgcccatggaaaatacaaaattcagtactttttgtaattcctgcctctcctttttattctttgatattttgttctggaaatgtgagccctgcattctgaatgagttttaggattatattctgattcactaattctcctttcaaccataacaaatttaaggcttatcccatatattgagttgctcaaagactttttttttttttttttgcccctggaagtgttttctaattctatgatctgtgccccttttttgtttttatttttaatttttctgatcaaggtgttgaaattaggtggtcaggtgaactcctcctggattctagtttatgggggataattatccttagttttcagggctattgtttacattccttctctccctattttaattgttttaattggtattctaaagagaattcagaggagaaattgcctgacactctgtcaccctgccatctaccagtaataccattttgctttatcttcaacagaatgagaaataatattcattttccattctggtgtctgtgagcttggttacattgctctgggcaccatggagagggatggagagaggagcaaagtcatagtgaggttcatgctacaatagtaaatatttctattgcatggactttagggtatagtgtgtcaatcatgagaatacttttcatttcattgtaacctctgtacttcccttgggccattcttaaaagtgttatctccgcagcttccttctctcattcttctttgtcccactctaggttttcactagcatttttatagcagaaatgtgcctaaaaatcattgcgctcgatccctaccactactttcgccgaggctggaacatttttgacagcattgttgctcttctgagttttgcagatgtaatgaactgtgtacttcaaaagagaagctggccattcttgcgttccttcagagtggtaaggcactttcttattttactgcataaacgtagctgcctaagtggaaaaaacgttttgagtgagttcagtggttatcttgtactaaactttaatttatcttaccttaaccccagaaccaaaactgcactcctcttcctgcacaggtctttaatagtcttgcaagtccctggggggacttcgcttaactgaacccttatacccttagcccattcctgccagagatgaccctttaggcaactgggtacaaaattgtgtctcccagtgtgaggactctgttccttgctctgtgcacaacccttccgacactctttttttcccatggagctgtgaggcaataaataaataagggaaaatattcctatctttcaggtcatattgggctcgccaaggggggcaaagactatagaatgccggggaggaatgcaggggagctgatggcaggtgctatctatctcacaagtttccttctcactgctgccagtgctacatttctgttctgtagtctttgcctgctatccagtttggaagcattctggaaacctttacaaagtacctaatataaactgacatgagggaaggcacaaaggatgaggaaatcattgtctttgagaaggttgcagcacaggagtgatacaagactgggctacatgcacagtacagtgtgacagagcccaggaaaggtatagacagaggactacagagaaatccaatctgagaaggggaactagaaaacctccaaggtgggattttgtcccctttcaaagatatttacctttttttttcagataggatttttaagcctatagagtaagacacctcattcagttacctaaatgtacattttatattttttatacttgggatatagtaagaggttacactgctcaaagtcaggtgttattaagctttcctactaatgttttattagcactcaggtaagcaaaattgcatttgctttatcattgtttaggcttattacagccaggctctaatgcacggaaatctgtggcattgtctctgtatgagaatggaaccacaggtttttcctgggatgctcctagctcccctttgagtagacaatgacagtcctcttcaagcagaagccttactgacctgcaacatttccatccccaaataggggatgtgcttaacaaaattgtactttggagtaaaaccgtcagtttatatcaaaagttaatataagaaacaacctataaaacaagttgctatgttttctctaaggttgtttcctataaagtccgtgaagatctaggataaaatttctctgtggaaaaagtatacaagtcttgaatagctggttgccttttctctcctgactacaaatgccatattactctaatcattcttatgaggcttagattcagactcgtggcctgaattatataatgcagaagttagcaaactttttctgtaaagggccacatggtaaatgttttcagccttacaggctgtgtggtctgtgtggcaaccgttaaactttgccattgtagcacaaaagaagccatagactttcaaaaaccagtgagcatggctatgttccaataaactttatttatggatgctgaaacttgaacttcatatgattttaatgcatcatgaaatatccttttgattattgttattttcttttttgagacagagtttggctctgttgcccaggctggagtacagtggcgtgatctcagctcactgcaacctctgcctcccaggctcaagccatcctccctcgtcagcctcccgagtagctgggactacagacgcacaccaccacgcctggctaatttttgtattttttgtagagatgggggtttcaccatgttgcccaggctggtcttgaactctcctgtgctcaagcgatcacccacctcagtctcccaaagtgctgggattacagatgagagccactgtgcctggcctgattatttttcaatcatttaaatgtggaaaagtattcttgtctctgaggtcatacaaaaataggcaatggactgtatttggctctcaggccagagttcgctgacgcttggtatattacatataattccaaaatattcattttatataataattatgtagctcagtcaccatgctgatcccaaagtccttaatgattaaaaaactaaaacaaaatatttccttttttttttttttttatgagatggagtcttgctctgtctccaggctggagtgcaatggcgcaatctcagctcactgcaacctctgactcacaggttcaagcgattcccctgcctcagcctcccgagtagctgggactacaggcatgcgccaccatgcccagctaatttttttgtattttagtagagacggggtttcaccatgttggccaggatggtctcaatctcctgaccttgtgatccacccgccttggcctcccaaagtgctgggattacaggcgtgagccactgtgcccggccaatgtttccattttcaaataagaaagtagatacaggtgagcattagattatgacagcgatctgatggctatgttcaggatagatttaactttgaagagagttttggatgtcataagtttgggtatatgtcatttgctttatagatgagcagatggagtttgtccttaactggcttttcttccatttttgtttgttgtctttttctacagctcagggtcttcaagttagccaaatcctggccaactttgaacacactaattaagataatcggcaactctgtcggagcccttggaagcctgactgtggtcctggtcattgtgatctttattttctcagtagttggcatgcagctttttggccgtagcttcaattcccaaaagagtccaaaactctgtaacccgacaggcccgacagtctcatgtttacggcactggcacatgggggatttctggcactccttcctagtggtattccgcatcctctgcggggaatggatcgaaaatatgtgggaatgtatgcaagaagcgaatgcatcatcatcattgtgtgttattgtcttcatattgatcacggtgataggaaaacttgtggtatgtgtcttagatttttttcaaaaaaaaaaaaaagatcctacatgcctctcaaatgcattacttcatttgcaaaactttactagtaaaaattattattctaaatataatgccaaataaatatttgaaatattcattcaaattttgtttgagaaaagtatgataagcatgaaaaaacctctttgacacatattactcatttgactgatgcccccaaatttattttattccagatgattattctaagacaatagtattctcttccccagtgattggctgaaataggagttagtgagttaatttggtcaataggatgtaaagagatgtccactggagcaatttgggaacaatcttttgttcttaagaaatatgtgtttttaaaaaatgatcgttttacttcctctgggcttttttatgactgtgacccctggaaaagccagatcatgagcttagagctgtggtggaattgcccacaggaatatggatctgacatccaggactgctgtgcaatcctctcctgtttgcacgaattgagagatggtgtactttgtgcagtgtctttaggtccctgttcccctaacttcaatgaggtattggggcctagccagaggggtttggaccaaacctgcaaacattatgcaaccatgagaagagccagcctaaaacaaagccaacactgaggcaggtagagtgaaaagagagaacaaacctgtattcatgtcataattggcctgctgttctattttcgaacttcttgttatgctacagatttttgttgtataagctggcttgagtctgttacttgcagctggaagcatagatatttatgaggaggctaattaagtgcacttcattgccttactgcacaagatcttcaggatcaagttggggttatagtgcaatataattaactctctacacacgatagctttatcctaagtacctaataaatggtgtgcctagacactaagtgatacatacaaaagctcagaagaacagggcatcaccagtgggagtgggaggagagcaccgagaaaggattcgtggaagattacagaacttgagaagaccacttatatggtaaggaggacttagacagatagaggagagcttaagcaaagatccagaggtgggaattctcacagtgcagctgaggaactgtgactagacccatttacacccaccaggcacttctctccaaaggctgtctattgtcgagctgaagagagccacaaacaaaggaatttgaggaggtaaagatgatgaattagagagtgtgtaattatgagcaaagaacccaggtaggaagctattgggattatgtgaatttgaagtgatatgtggttcaacgaaagagttgcatatttggtccaactcgcttggcttggccccagtacgttactaaggttagggcaacaggacctaaagaaactgtaaagtacatcatctcacaaatattcaaataagaaaggactgtacattgggcttgaatatcagattcatatccttgtgggaaattccagcaaaaatcaaagctcactatccagctgttcctcaagaaatgtactctcaattttgccatatggttatcccattctgctttaccctggtaagggtctactcatccatattatttatatgtagggaaagtggacttggctatttgcaccctttaatttcaatttttattctgtcttactgtttctatttctttctcaatcttttatttattggatagatgagctttcttaggagacagtgggacataaaactctaatttgattctgtttttagtcttggggaaaagttgtcctggaaacccactatatcttttcctttgctaaactttcctttcttcttgctacccaccccattcccaggtgctcaacctcttcattgccttactgctcaattcctttagcaatgaggaaagaaatggaaacttagaaggagaggccaggaaaactaaagtccagttagcactggatcgattccgccgggctttttgttttgtgagacacactcttgagcatttctgtcacaagtggtgcaggaagcaaaacttaccacagcaaaaagaggtggcaggaggctgtgctgcacaaagcaaagacatcattcccctggtcatggagatgaaaaggggctcagagacccaggaggagcttggtatactaacctctgtaccaaagaccctgggcgtcaggcatgattggacttggttggcaccacttgcggaggaggaagatgacgttgaattttctggtgaagataatgcacagcgcatcacacaacctgagcctgaacaacaggtatgaaggttcacacatagacttaaaggtcatacaaagctggagttatcacagggcactggtagcctgcccttttctaggcactatgcaaggataataagggtacaaaacgtggctgccctttgatacccatgtgcacatctcaggacaggttctttattgtggtcctgcaggtgtggcacagataggaggtgtcagaagagttcagaggggagcaaaatcagagtgggctgggatgacagggggagttcctttggttgaactctacaagaaatgtagaatttggactggctgaaaagtgaggaaaaggggattgggaagtaaactgaatagcatgttttgtttgttggttggtttgtttgttttagaaaaaaaaggcagtgctgggaacaaactcagtttctgcagagaccaatcttgtgggtgaggagtggtgggagatgagggctgtcagggagtgtgagggtaatggatattgtattagtctattcaggctgctataacaaaatattatagactgggtaacttctaaacaagagaaatttatttctcgcagctctgaaggctgggaagtttcagatcaaggcagtgacagatttgatgtctgaggagggcctgtttactgactcatatttgatagctataaatttctctctaaccaatgtttagctatatcaaatacattttattttcatttttattttctatatatttaattatattttattttatcttattttctaattcttcttatgatttcttctttgacccactgcttatttaaaaatgtgttgtttaatatttataaatatctcaaatttctatttgttattaatttcgaatttcactccattgtgatcagagaacatactttgtacaatttcagcccttttaaatttttgaggcttgttttgtggcatagtgtattgtctatcctggaaatgttccatgtgtacctgacaagaatgtgtattctgccatttggaattaagtgttctatagatgtctgctaggtttaactggcttatagttttgttcaaatcttccatttccctgttgatcttctatctagttgttattcattcatttctgaaaataaggtattgagatctccaatgtttattgtgaattgtctgtttcttccaacagttatgtcaattttcatttcatatattttgggtctcttctgttaggtgtgtatatatgtttataaatgctatatcttcccaatattttggttcttttatcattataaaatgtccctctttatctctagtaagttttttgtttttaaatctattttgtctgatgttaatagagtcatcccagcttcttttatggttgctgtttgcataacatgtctttttccatccttttattttcaatctatttatatctttgaacccaaaatgtgtcctctgcagacagtgtataattggatcttgttttcttatctattctggcaatctctgccttctgattggattggttaaaccattcatatttaatgctgttgttaattcagtttatttacttctcatattttcctgtttgtcttctatatgtcttccatgttttttcctttattatttctctactgcttcacttgcattaagtaaatattttctagtataacattttaataactttagttttttcaaaatctttttgaattatttccttatttgggtactctaaaatttgacatatacatctaactcatcagagtctatctcagatttatattaattccagtgagctatagaaatattactcatatatagctctatttcctctctcctgtttttgtattgttttaaattctacatattatattcatatatgttaaaacccaaacaacttttttttattattgcttaatataactagatgtctactgaaggagctgagaaaataaaagaaaataagtgtatatttataagatttattttaataaacttcttagttactcttggctgtcttcatttgttcctgtgactgtgagttacctgcaggtgtgattttcttactccaatgcaactttgctcccacccatatcctttgtgctcttattagcaaatatattttatttctatatgttacatacccagcaacacaattttaaacatattgttttacacaattgcttttgaaatcagctaaaagaagaaaggaaaagaaatatatattttttatcatacttgtgtgttgtattaccatttagggtcacttgttttttgcctgtaggatgtcctttagtattctttataaggtaggcgaactaccaaagaattctctgtgtttttctgggaatgtgattatttcatcttcatttttgaaagatagcctcactagatataaaaatcttggttcactgttgttttttctttcagcactttgaatatatcatatcactgccttttggtctccattatttctaatgcaaggtcagtgttaattttatcaatgtcaccttgtacatgatgaaccacttttctcttgctactttcaagattttctcttttctttgtctttcagcacttttactatgatatgtctaggtgtggatctctttgtgttttttctacttggggtttcattgggcttcttagatgtggagtgctaggatttgaatgtgtcctctaaagtttatatgttggagaattaattcccaaagtaacaatgttgagaggtaagacctttaataggtgattagattatgaggactctggtctcatgaatggattaatgctgttattgtgggagtagtttagttactgtggaagtgggttcctaataaaagaatgagtttgctgccttccctcctttctctttcttgccatgtggtgatgccttctgccatgttatgatgcagcaggaagtccttcacaagatactggcctgttgatcttggtcttcccagcctccagaactgtaggaaatacatatctgttctttataaattactaatttcaggaattctattatagcagcataaattggactaagacgtgtagattaatgttttcgatcaattttgaggagtcttcagccattacttatttaagtattttttctgttcctttctctctttcctttctggttggtgtgcttaatggtgcaccacatttctctgaggctctttttatttttctttcttttgttttctctgtgctctttagattgcacagtctctgttgattcatctttaaattcactggttctttcttcaaatgtactgttggtctctctagtgactttttcatttcagttatgataattttcaactccaaagtttctatttggttcttttcaaaatataatttctattgatattttgtatttgattgtatatggtcatagtatcttttatttccttaagcattgtaccttttaattctttaaatatatttataatggcttctttgcattctttttctattagctctgacatcttgaccctttcatgtgcagtttctgttactgactgttttcccctgtgtgcgtcacactttcttgttttttgcacatttcatatttttgttttgttttgaattggacattttaagtaacatattgtggaaactctataactgattcacttttctcctctctgaagcttctttattaaatggtaatctggctagactattttagtggaatctgctccctctccaacctatccccctccattcacacacaatgtgaaagctttggtgtcactcctaggagagtacatccttggatgtgcacacggtcagtgtaggatgactgttgtttcagcaaggctatctttgtctccttttgtgatctctctgttaagctgtctgcctcttttggtattacacttcgattttaggctcaactaattgctggataattgctctattttccttgacaatgccatggggcataaattgctcaactgtctgattcaattaaattcaggaagtgatagcttttaagcgcagtctttgagatttgttttgaccccagggggactctccttagccatcactttccgtagttctttgtggtgaatttgctgacctatgttttagtttcttgcctttaatgaaggagagctaccaatctcttcttatttgcttatgatcaaaatatccaatatccattgttttcaagaacactcttagacttatacttccccacaccactttgtttcaaataaagtcagttctatggagagcttcagagctcttttttcttatgaattacctcccactctgggcaaactcttttaagcacaattccaggcacttgggcaggggcagtagcctctcaacttctcagtttccttcttccttaatcctccccacccccagagcttttgccctacaagtaagctggaatgaggatgattctagtattcttgggctgccgcttctgggataaagtctctgccctatgagtggagggctagatggaaaaagggagccaactttttggccacactcaccagaaatttagaggccttaactcagagttggaagagataagaaatgctgatggcctgcagctgctgctgcttttttttttttccataactcatgcatttttattggtaggcatttcatggtggtgtaatcatttatgcattggaaaatgggattgtttttgatgatactaaacagcatttatttctttattttattttattttattttattttattttattttattttattttattttattttattttatttttttgagatggagtctcgctctgtcgcccaggctggagtgcagtggcatgatctccgctcactgcaagctctggctcccgggttcctgccattctcctgcctcagcctcccgagtagctgggatgacaggcgccggccaccacactcggctgatttttttgtatttttagtagagatggggtttcaccatgttagccaggatggtctcgatctcctgacctcgtgatctgctctcctcggcctcccaaagtgctgggattacaggcgtgagccaccgcgcccggccagcatttctttatttcaaatgcattgaatgaccaccatgtgacaggccttgcactaaaataaaataagtatgcaataagtaattttttttttgaggcggagttttgctcttgccacccaggctggagtgcaacggcacaatctcatctcactgcaacctctgcttgccgagttcaagcgattctcctgcctcagcctcccaagtagctgggattacaggtgtgtgccaccatgcctggctaatttggtatttttagtagagatggggtttcaccatattggccagcctggtcttgaactctggacctcaggtgatccgcccacctcagcctcccaaagtgcaggaattacaggcataagccaccgtgcctggcctgcaataggtaatttaacatgtaggctgtattttttttaatgtaagcatttaaaaagattttccccttatgcagatatcattgatgtgcctttccattcaaaaggctcaatatcttttttttcaatttcattaaaaaaaatttaatttcagtagtttttggggaataagtggtttttggttacatggataagttctttagcagtgatttgtgagattttggtgcacccatcaccacatcccttgattgagagctagggtagagggagccctatcttcttggccaccttggtctagagtggagcctccataaaacttggctggaagggatggggggagaggtcagatcatggcttaagtgtcatcaatttctgctgttcttactgaattttagtagattttcttgaacaaatgtttcttcatttgctgtgcactctcagaataatttctagagactttaaattatttttaaaacagttttcaccacttatgcttatttccctagggagaacgtccgcagagattatcatgctatcatccaggaagtgaaactctatgtaacttctttattaaattctatatgtattaatttaaagacattttcagattattatgtaactttcatctttttctcaagtgaattcacctcctagttgttaattttaggaagtctactgattttatgtttgtttcctcatatattttggaatgttagcttaaaagctcatctttagtgggaagatctgtcattctctttgcagtctaagttctatgattgtctgtaataaatccttctgtggcatccatttcagatccatgtcttctatcaccagctttgggttgttgtctaataatgatacaagtcatattgcagatccagtcactgaaccagtgggtacttttgcccaggtcccatttctgaggttgtacttcttcctgtctccctacgtatgcagctttatacaattgtaatcataagcgtttgctgcgacatttgtgttttttggctttctctcttaagtgcaaaaactttacctcagcccacagtttcaagccttaaatatagctctggttcccttcctcatctagggtacttttagacaccattacctgctatcttatttaaattcttactactttatatttcttttctgtgtctagtccacagacaggttacccctttttgtatgtgtatgtttgtgaggtatattcgtggctatatttgtatgtgtgtgtatttttacatatgctattacatgtgtggagaaatgtttctgaatcatgaccttataatgtcagagttgcaagagtcttcacatagatgttaggataaaacattcacccaagatgtgactgtaaccagcaaaaggatccgtccggctgctagctgcttatgaaaagaattcaaaataataacaaattatgataagaaagagcaatattctcttattatctgtgccagcaaggggaagagcagagacccattctactcttcaatttgtggaaggaatgcgggggtttttattttattttattttttatttttttattttatcattattatactttaagttttagggtacatgtgcacaacgtgcaggtttgttacatatgtatacatatgccatgttggtgtgctgcacgcattaactcgtcatttagcattaggtatatctcctaatgctatccctcccccctccccccaccccacaacagtcccggaatgcgggggtttttaaagaaagggtttgagatgcagaataggcaagaggggctaggaggtgccaggtggtgtgacttgctccagtggcccctcttgaattattgtcccatgtggtgaaggggctggtgccatcatggatcctgccaggttataaattagttgcagtcaatcttgtagtcactctacagcctgaagtaggttctgttcttgaagtaatcttgttggggagagaattctagaggtacctggtccctatcaggatctgactctcgaagcttctaagaaaacatatgaccacataaaagaacatggcgtgtacttaaaaagcatttaggtaaataaatgtgcataaggtatgggaatatagtatgggaaaggaaaggcagtggaggctcacagcacattccaaggctgtatttcaagataagaggtaacacatatgcaggttgtctcaaagttgtatcttgagacttggaggggaaagaggaagaggaaaagaagaaaaaaatgtttaaaacacagttcgaggctcagctgccaagctgcttggttacatgactgtacacatccttattagatattcctgtaggtcatcagaacaaatttatttttcagttttatgtagtgatatgttttattatttttctttatgtcttttagtttcctgttttgctaaggaaactctctgtaccccacatgatagcaagttatttttcaaatttttcttttaaaatgtttacccatttatttttacatcagaatgtcataagattatatattttatttttactatattatggcattgtgtaccatttattaaataatttattatctagccattgaattgaaagagcacatttaaaatatattaaatccccatgtaaattatattaaatctccatgtaagttttatttctgaattacttgcggagttttgtaccagaaccatactgttttgattatgtatctttgtaacaagttcagtatctgtttcctctagtagttttcccagaattatattatgttgagtttttccaggagcagtttctaaagagaaaaaagagtaataatgtcaaaggcttattctcatgacaaagagaaaaccaaatagcattcaaacttctttcatcttaagtgacatgtccaggaggaatattaattctattctgggctctctgtgttaggcctatgagctccatcaggagaacaagaagcccacgagccagagagttcaaagtgtggaaattgacatgttctctgaagatgagcctcatctgaccatacaggatccccgaaaggtaattttcctaggatgttgtcagaggaacttgtggctcatccacacaccttctccaggatagttattatggaaaaatggcacaattaatgcagagaaaattgcaagaatcgagttttgagcaaaagtctaggccaggtttctcaactttactagtatgacatttgaagcaggacaattatttgtcatggtgagcttttctgtgaattgtaagatgtttatccatatccttggcctctatgcatttgatgccagtagcatccgccagttaaggtaatgaaaaatgtctctagacattgccaaaatgtctcctggagggccaaagaaataagaaccactggtctaggcctattattccaggaggtgagacagtggaaaattatagtctcagtaaagtagccttcttctcatcacataattggagttaggcagcctatcagggttatgatctgtagggagaaaacgtggaggtactgtatcttcatatgcattgctattcctcagctatagagatgagctagagagttctcttctgaagtcaggctggtcatagcacttagaaaaggacccagcaggaggggtgtttcttgacacctctcatcctagaaacctttgcctagttcatttcatccttaaaaaatcagacaatgagaaactccgtactactatggtgaaagaaggtcttagtaaaaggcacccccttcgttttgttctgatgtgcagaagtctgatgttaccagtatactatcagaatgtagcaccattgatcttcaggatggctttggatggttacctgagatggttcccaaaaagcaaccagagagatgtttgcccaaaggtaagtggcagtatttctgcatccagttcacagaatctttggatggggtttctgttcttctttgaagctctgtggttttagtagatatcatctttctacttctattggagacaaaagcaatgagagggcacccgtagattcttgaggcgattgtcggatctaggcagaggggatttcaggaaattcttgctttaattgggctcctctcacatggcccaaaatgccaggtaaacactctggaaaactctcttagaaagcccactgggccaatatgtctgccactttctatggttcccagggcattcaatgtcagggtgtatttgaggtgaaagaccaagaaaagagtttagacattgtagtcaggatctttagcttagaagccagactgcctgagctcaaattctggccttgccacttatgagctgtgtgacttgttcaatttagttaacctctctgtgctttatttctaaaatgagggtaataatagtatccaaagcaaagagttgttgtgactattaaatgagtgaatataaatcacttagaagagcatctggaacaaaaataagcaatcaataaatgcaggctttcctaattccttgagtggatatagtggctttttcctataggcctttactatttgttatattcattgtagtgaacttatttgcactggtttcccccatgaggtccttaaaaacaaaggcagtgacttcatcagcattgtatctctagtgtaagaatagaagccggcccagaaatgggttcaacaaatgttgataaataaataagtgaaacaaattaatgaatgaatctaaaaaaattatctataagtttaggattaaattgggtccagaagcaacacaaataacaggtttcaaactcacattccaggttgcttaacagctccaaagctggacaggagttggattaaggatttccagtagattgcagttctcctcatttatgtttgcactggctcttgaggtgtgcatatgatgtcaacagtggagatgagaaagaaaggtggttttatcaaagaagggaggagtgggataaaagccaggaaaaaagtgtagtcttttaggaagatgaacctactgatgtttttggaagaagaaaagaggcagagtgaagagagcccatagtggtttaagaagatgaggaaaggagcagaatgttataatcatcatgaataaggatcagcagaatttgtacaaggggaggaggagaaaaggtggaaagggcaatgtggtctatattgaaggcctgtgtgtgttcagaacaaatgctcagctctttgtaaacgtctcgacatttgatcaaattctttcgtgtatgacctgagaggttcacaaagcctgtggccatcctacctcattccctggagtcctccagacatgatctctttatgattaccaaaaaaattgctgcataacaaacaactacaaaacctcagtggcataaaatagtaaacatgtgcctgcaggattcagctgatcttgattggcttcattcatgcaagtgttatctagcctgggctcaacagggcaacatggctctactccacatgtctatcatcctccttccagacccaatggggtagcctgaatttgcctttttttatggagatggcacaagacagcaagtggaagcatgcaaggcttttcaagacctgggctcagaactggcacagtgtgacttccattccactctattggctaaagcaagtcacatggcagggaccagatttaagatgttagaaaaagatgctctacttctttaatgggagcaactgcaggtcgcatggcaaggggcatgaacacagaaaggggtgaagagttgcattttaatgcagtttattacagacactaatgatagtgctaccattaattcctttcaggctttggttgctgctttccatgctgtagcgtggacaagagaaagcctccctgggtcatttggtggaacctgcggaaaacctgctaccaaatagtgaaacacagctggtttgagagctttattatctttgtgattctgctgagcagtggggcactggtaaatcatcattgtcttgtggagacattgggcatcagggcagctggggaagctgcactctgacttggcttctcgtgggactgtgaatatgggagaccagacagaagtggtctctgatgctgctggttcccgcagtgggcagggttttgcacagcttctgaaatcgtgctcaactgggatatcaccaagcaaagatgctttatctgtgtggaagactaactaaaaccagcactttaaagtggccactagagtctggtccttgatcatctacctctcatttttgggggatttctagacattttcactgtatcctacatagttcttcctctagacagcagtgcttctactctccctgttaccataagccatagtgctgttttctgaaaggtaaaatattatgggagggagttacagggaccagattaggatataataagttgccttggtattttctgtcattcatgatcccttgaaagaaaggacaaggagatgttgctttatatgcatggtcaaagtgtggtatgagtcccaatgagatttagaaataactctgaacccatcagcttctatagccatagagctatccactcctttatgctctctctccacaccttctggtccttcttgtctccctttctcctccctgctagggagggatagtatcttttctcttatcacctgcatatttcgccctctccttttctattttctgcttttttctatcatgcatcttcccttaaaatgatcatacagtaatgtggagctaaataatagggaaccaaattctcttactgtttgacataacaaagttatgagtttgttatgagagtttggttccatattactaaacccaggagccttgggttctcccctgctaagagtgacagaacatttcacagtgaatcactagcaagtggaaaaagacaaggaaatgtcttgctcctacaccccatagcttctggttagtgttttacacttgtgtgatctctaggtgaaaagagatgaatacataccagagcccaccggggactgtgatcaacatacatgtccatttgtctacttactacagtgtaaattattcttcaaatagaaaagcagatttctctaaaaccatcccagagaattcccttaataaatttttattgttaatcttgggtctagggttacctgtagactttctggtgactacattttcactggctgtctactgttactcaagtgtagggtttcttgtatttattccacaaatggtacttatgatataggcagtgggaaagcagtgacagtgccaaaaggccacagcaaaaatgccccatggtgccataaaaagaaaatgtatgatcagaaatgtagcagagggcacacaactccagttcttatctgccttcggaaaggcaggtgtaggctgggcagagcaaagctgaacacacaatgcagagggtgccaggggaaggacccagcccatatttctctgtacatatttgtagagaatgagaacaagagacatcaagttgtttgccactatatgtgtctatcagcagcagcagcagcatcacctggaagcttgttagaaacgcagagtattacattgtaacaagcagtccattgtaacaagttccctaggtgatttggggttcattagagtttgagaaactctggtctaggcaactatgtaataataagagcttcctgtgtcagaaaatggcctagatataatgtggaagcctctgaagctcaattgcaggtataagcgtgctcatccattgagctaactcagatctgctgaaccagcttactggtaagcttcccaaataagggaggaaatgagcacccaataccattcagatttgtttatcctcaagaggcaaacaaacgaagtccctgacctccaggagcctgaagtctagtaggaaagacagctggagtgattatagaccagaaagtatagatcaagatagatagaacaattaagtggtctactcagggaagcagtgggtgacatgggagcatgtaggatgggaacctaacccaatcctgctggaacgggacagtttcctatagaaaatatcagctaagctgaaatcttaaagctgaagagctgaaagagcagaggatgagatagagggccttcttcagccagaaaccaatttggcaattggaagtgagactgttttactcttttgcattctttttttcaccccaggactttggagctgtgggcttaccctagtctccaacagcaaggatgattcccttcctgccttcaatgttgacgtaaatttcatgggcagctttagtaacaggccgtcttcctttctttcattctcagtaactctgtaaaggccaaaaggacagcttatacgctagttatatagaccctgtagaatcacatacagtttgcgtgagggaagtgtttggatgtagcattaaaaagggtctctctgaaagccaggatctctttttcataattacaaataacaatgtttaatattcaaagtaatttacactgggagctttagcctagagtgttccaaattttgttaatgtcatggcacacataagaaatgacactatttgtagggaatggtaaggtaaatggataaggctgtttgtagggatagatgaggggcatcagggttggcaggatttagagaacgggctaaggcacttggacttaatgttataagcaataaagagacactgaattaatccaccaaggcaattgggaggatgagagatggtctatgccactgggtggtcctgggaatgttggcaagacatatttggcaggagttgaaaagatgaggaagcccaggaaataatgtgctgatccattaggaagatgttttaatattcaggggaccagtaataagcagttgaggaactattgtgacaacagaagaaagaagattttccttcttccatttttacttactcaaggaatggattccattggaaaagtttagccttaatatcttttgagcagaacctcattacgaagagagataccagtttttattcatataaggaagaaaaacaaaaagtaaagttaccaaggagttctttgcaaatattcaacctggcctatggctatgctttttcatttcagatatttgaagatgttcaccttgagaaccaacccaaaatccaagaattactaaattgtactgacattatttttacacatatttttatcctggagatggtactaaaatgggtagccttcggatttggaaagtatttcaccagtgcctggtgctgccttgatttcatcattgtgattgtaagtttaccatctctgtgtcccacacaggctggggtagtggttaaggcagggatcatatggaggctgcttttcctgtgtgccgcatatggatgtctgtctaaaatagtttttcttgttatcattgcctcttcacagtacttgtaagtagttgtcatttgtctgtaagcagtttagcctttcctaggtcccgctcatcatacactacactttatatgctcaccactacaacctttcccatgatgggattcattcacttctctccataagcactgtttatgtataatatgtacctagaataactttcagtatcctcgattttttcttcttccaactttctatttcttttcaagacttctcaaagctggtcagcagccaatagactaggctaatatccatcttaattgtcaagcagcataagaggattgttcacatacagtctctcatttaatatgcatgacaatgttctgaattaagcagcattgtatgacacctcccacactgtatacaaggaaacctgaagctcagaggattatcaatttgtttcaggtcatagagctgataagtggtgaaattgggattcacgtgtctagctgtatgacacaaaagctaataatagtattagtggatcacatttattgagtgctttctctgtatcaagtactcttccatatgctccaaatgccttctctcttttagttgtcatagccactctgtggcaggtgctactatttttgtatattcagagaaagaaagtaagtcatagagaggctaagaaacatgttcaggattgcccagctagaagtggtggaggtgagatacaaacctcgtaagcctcactccaaagctcttgatttaacattacatcctttttttaagattaattttatgtttactgatacatagtagatggacatattttcaggatacatgtgattatgtaatacctttatataattaaaactggtgcaacctagtaagtctcactccagggcccttgattttaacattacctctttccatcatgatgtaattagttaaactttgtccctgctatgcaaggaagtagataagacaaatatctgagcataaaccatgtggtcaggaaaccccactggagaaccataatgttgttggttagcacaaatagaccatgtgttcatttaatatggacatcaatattctgagttaatcagtattacatgacatctaccacattactaacaagaaaaccagaggctcagagacaaggaaacagaagctcattgtggttcaggcattttagaaaggtataaatgccatagaaactacaacaggattcaaagatgggaataaaaacatccacgtttgtcagtcctattaatttctagagagcaaataactctgtacgtattatcttaatagattatagtaaaaagaaaaccctaaaaactgtgtgaacagatgattgttatctccattatagggaactctgttttaccggatacaagccctacatttaggagcctgggtcctaaagctaattggtctaccctctttttgtgtaaccttaagcaaaacatttcccctcttttgacaataattttctcacaggtaaaaatgaggatgtggactataaattgcccaaattcactgaatacataatagaaagctagtgatagtttcactagaaatctagtgatcgccattaaaaatatcaaaacagttgtccaaagccacactgtcaaaaaagggtaccaggctgagatgggtgggtttatttatttatttatttatttattatatttcaataggctttcagggaacaggtggtgtttggttacctgaataagttatttagcggtgatttctgagattttggtgccccatcgcccgatcagtgtacactgtacctaatgtagtcttttatccctcacaccctcatttcccctgagtccccagagtccattgtattattcttacaactttgtgtcctcttagcttaggtctctcttatgagtaagaacataaaatgtttggttttccattcctgagttacttcacttagaataatagtctccaattccatccaggttgctgtgaaagccactattttggtcctttttatggctgagtagtattccatggtgtatgtatatagtatataccaaagactatatatatatggtatatacaccatatatataccatatatatagtatatacaccatatatataccatatatatagtatatacaccatatatataccatatatatagtatatacaccatatatataccatatatatagtatatacaccatatatataccatatatatagtatatacaccatatatataccatatatatagtatatacaccatatatataccatatatatagtatatacaccatatatataccatatatatagtatatacaccatatatataccatatatatagtatatacaccatatatataccatatatatagtatatacaccatatatataccatatatatagtatatacaccatatatataccatatatatagtatatacaccatatatataccatatatatagtatatacaccatatatataccatatatatagtatatacaccatatatataccatatatagtatatacaccatatatataccatatatatagtatatacaccatatatataccatatatatagtatatacaccatatatataccatatatatagtatatacaccatatatataccatatatatagtatatacaccatatatataccatatatatagtatatacaccatatatataccatatatatagtatatacaccatatatatagtatatacaccatatatataccatatatatagtatatacaccatatatataccatatatatagtatatacaccatatatataccatatatatacaccatatgtctctttctctctctatatatatatcacattttctttatccactggttgattgatgggcatttgggctgaatccatatttttgcaattgcgaattgtgctgctataaacgtgtgtgcaagtgtctttttcatataatgatttcctttcttctgagtagatacacattagtgggattgctggatcaaatgacagatctacttttagttctttaaggaatctccacattgttttccatagtggttgtactagtttacattcccaccagcagtgtagaagtgttctcttttcaccacatccacgccaacatctatcattttttgattagtgccattgttgcaggagtaaggtggtatcacattgtggttatgatttgtatttccctgataattagtgatgttgaacattttttcctatgtttgttggccatttgtaaatcttcttttgagaattgtccattcatgtcctttgcccacttttggatagaattatttgtttttttacttgctgatttgattgagttctttgtagattctggatattagtccttagtcagatgtatagattgcaaagattttcacccactctgtggatgtctgtttactgtgctgattgtttcttttgctgtgcagaagctttttagttttaagttccatctattcatctttgtttttgttgcatttgcttttgggttcttggtcatgaagtctttgcctaagccaatgtctagaagagtttttcccatgttatcttctagaatttgtatggtttcaggtcttagacttaaatccctgatccctcttgagttgattttcatataagatgagagatgaggatccagtttcattctcttacctgtagctatccagttatcccagcaccatttgttgaatagggtgctcttttcccaatttatgtttttgtttgctttgtcgaagatcggttggctgtaggtatttggctttatttctgggttctttattctgttcaattggtctgtgtgcctatttttataccagtaccatgctgttttggtgcctatggccttatagtacagttagaggtctgaaaatgtgatgtctccagatttgttctttttggttagtcttgctttgggtatgcaggctcttttttggttccatgtaaattttaagattgttttttctagttctgtgaagaatgatagtggtattttgatgggaattgcattgaatttgtagatcgcttttggtagtagggtcattttcacaatgttgattctacccatccatgaacatgagatgtgttttcatttgtttgtgtcattgatgatttctttcagcagtgttttgtagttttctttgtagaagtctttcacttccttggttaggtatattcctaagtattttattttattttattttcagctagtgtaaaaggggttgagttcttgacttgtttctcagcttggtcactgttggtgtatcacagtgctactgatttgtgtacattgattttgtatcctgaaactttgctgaattcatttgccagttctaggagttttttggatgactctaggattttctatgtatacaatcatatcatcaagaggcccagatggttttgcaggtaagttttaccaaacttccaaggaagaattaatctcatcttattcaaattgttacaaagaatagacaaaagaaggaaagcttgcaaatttatttaatgagataaacataatattgataataaatgaatagaacagaaatgaatcaaataagaaaataatcttacaattatatatctttgcaaatcacagataaagcactcaacaaatgtggtttactattactattattagccttgacatcatgcagactgtggtgtgaatctgaaattcaccacttatcagctgtatgacctgaaacaagttgctgatcctttgagcttcaggtttcctcatctataatatggtagatgttgcaaagtgctgcttagcttgggatattgttgtacagattaaatgagagaatgtatgtgaacagttctataatatttattgtcaatcaagattatataaaattaccatcataatttttattagaaaagcataaaccacaaaaagatacacaattcaactacatcaaaatgtagtaaaacttttatttttgtattcaacaatactctaattacagttacaaaccaactagaacctgggagacagtattttccacaacagatcattattattcacaacatatacaaatttcctacagattcacaggaaaaaacaacccagagtaagaatgggagaagtatacaaacagccaattcacaaaaggaataaacgtatgatgaaatatacactagttctatcaccagttagcacagaagtgcatattaaaatgagaggcctctttttactcattagattggaaaacaaaatatattgttttgaaacatggtctcactctgtcatccaggcttgagtgcagtggcaacctctgcctcccaagctcaattgatccttttgcctcagactcctaagtagctgggactacaggcgcccaccaccatgcccagctaatttttgtattttttatggagacagggttttaccatgttgcccaggctggtctcagactcctgagctcaagctatctgcctgcctcagcctcccaaagtgctgggattacaggcttgagcgactgtgcccagccatggcaaaaattttaaagttggataacatcgatatttagaaggatataggaaaatgccatggcaaaaattttaaagttggataacatcgatatttagaaggatataggaaaatgcgatctcaaaccactgctaataatttaattggtacagccactgtagggaatatttcgcactatattaagtaaaaatcacaaatgacccaactcacaatccacaaatatcacttgttatagatccaaggagaactcttgcatatgtacccaagaaaaatgcacacatctgcccagtgtactgttgtgcataatactgtccagtgtactgttttgcataataggaaagaaatggaaataacctaggtattcaccaaggaggaatggatccgtaaaacatgaagatttatatgctgtactattcctcaacagttacaaggagcaaaccataagaatataatcaacatgatgatttcaaaaacagtgcagagtgataaatgcaagttagattttaaaaataagataaaactagtagaagacttctcacttgaagagtacagtatggtgggaaagaatgtgggtgtttctatgtgtctcactgatacctgcaagtctgatggaacagaaacttgggtaaggtttaaggtaaagaggtgtataaggtctctgtaggaacatcccttctcaccaactatgacaatgatttggtaaaacagaagaattgctaaactttgccatctgttttcatctggctaggaataagtggagtatttgcgagaaagctacttaataacttaataacttaaataactctccaaaagtggtgccattgtaaacaaaaagcccactaaaaacattataaatacactgtaaattgattataaatttcaaaatcttaatattctgtcatattaactcaatttctcttcactactacaatgaggttggcaagatttgtgaggaatgtttttaggtaatagtgaactctgacatcagcttagtcaggactatcctgattcacttcctatccagctgagcaactcttcttccaagctgagcctctgaaaactctccataataagaatggctgaagatctgcagcaagcagattcaactcaagctcagcattgattccattgtgataatagaagcaaatcctaattcctcatatgaaagccaataccttctcgaattgtcctctactgagcatctgtaaatattgttaagatttaatttggtatacttaacagagctttctaatactcagttctgtcctattgagaagaagcatattgggagagaaaatagcatttaattccccaataaggagctatttggattaggggaaatattagcaaataatttattttttccatgtaactttttattttgatatcatttcaaactaagaaaaatgttgcaggaaatagtataatgaaatccacatattctttcttcaggttcaccaattattgtcacccatctgctttgtcatttttttctctctttttttccccctaaactgcttgagattaagttgcaagcatcaaacctattacccctaaacatgtcaatgtatatttcctatcaaggacaatgtctcacatgattacaatacagtgatcaaagttagaaatttaacattgattcaattaaaatccacatccattttcaaatttttcaaattcaccataaagatctttgttatggcaattgactatcataataaatttcaattgactgccataacaagattctttatggttaattccctttatgcatccacctcctacccccactccaatccaggatccaattcagcaccccagattacatgtgattgttatatctctttgctttcctttaattcacaacaatttctcggattttctatgtctttcactaaacaaataacgtgagtgcattgttcccacgtttatggactgtagctttggtagataaggagaaaaatggactttccagctggacaccaagtcaggtacattatctgtggcctctcttcccatcaggtctctgtgaccaccctcattaacttaatggaattgaagtccttccggactctacgagcactgaggcctcttcgtgcgctgtcccagtttgaaggaatgaaggtacattctgcagaagaatgggtagaagttcagttaacagagaaaggtggaaagaccaacagttctttttgggctgagatttccttaaattgccaagcttttcctgggttacttcccagcctgcccagtgcttagaatttgaggggtagagaaaagcctaagatatactttctaccctaaaagcttctgtgacagccaagatgagctgtagctttgcctcagaatcctggggtaggtgtccataagtctctaacactgtcatcaccagggcacttctcaaggtatcctcagtggcaacagagaggacccattatgtagggagctgagagcagggcttgtcatggggatggggcacatgtatgtggagattaaggacagagctccaagagatcaagccctgcacatcaggcccatgctgagaagttgaagagcctggtgcatcctacccatctgttatggttttctttgcttttgtttccataaggtggtggtcaatgctctcataggtgccatacctgccattctgaatgttttgcttgtctgcctcattttctggctcgtattttgtattctgggagtatacttcttttctggaaaatttgggaaatgcattaatggaacagactcagttataaattataccatcattacaaataaaagtcaatgtgaaagtggcaatttctcttggatcaaccagaaagtcaactttgacaatgtgggaaatgcttacctcgctctgctgcaagtggtaagtacagtcagtatgtttttcactctgaggagaaaaaccttcagagaatcatgaattgtttctcagctaataaaaatgcagtgactccattgtgataatagaagcaaatcctaattccttatatgaaagccaatgccttctggaattgtcctctactgagcatctgcaacttcattgactgctgagcctcagcttcctagtgatgcccctttaaggatctgtacatctcaccttgtcctgtatggcaccttgctggctctccacatctccaggcagagaggagtggagcctcaggtgtaggtcatgacactttgaacagttccctgtttaaagcacagttgccaggtcttgaacaggcagtgcaaatacatatggcatcagaaaagaaccctttaactcttagccagtctcttttcagctgttgggccacagcttcagcctctctggtaacttttaaggtggaaatttcttgtttttaaactttgtatcttgtacaaatgaagaagaagaaaaaaatccaagacacacacccttgagttcccttctactgttcttttatttgagcatcctgtcctagaaggttggggtatcatcttatatattcagcccactgggcctcacctgcttttccatgccatgtatctgttgatggcaagtctacatttgtattattcatgtttttctgcttttgttgcaggcaacatttaagggctggatggatattatatatgcagctgttgattccacagaggtgagtcagtgttctaccatgttctggagtgttatggtcaagtcagagatatcatgactacatggacagtccagaactggcgtcatagttccagcagctggggttctctgccttgttttctttggaacaaaacactatgagataccactgcctaatacaaaggattcttatgcatcctctagtgagtatctgataccccagtattctctgaagtccagtcttctttctccatggtggccaaggaaaaaccactcatacaggagatggagccagaagtggcagaatcacaggatgccttgattttcttcttccctcttctccaaatggttggatagtcagaaaccaaatttcaaagagtatctgttttagattgtgggaaaccttaagactgcactaaatttgcaagggagaccctcgcatggctccagactccctagtgatggccaactgttgaattttagagtttctagtgatgaccagctgttgaattttagttaaagaaaagataatcacagattcccaaagttggaattgcactcagtaatctagcctagtttctattttccagcttggaaagttgagggataaaaagaaagagtttcccaaagccatagagtaagcagatggttggctcaagaatggagtcaatggcagaaattattgtttcctattatagcacatgtgtgtgtttcgacctatttgggagtctgcagagttgatgcctaacacctaaaaagtattcagtacctgtgagctggtacagactgagtatcccttatctgaaatgcttgggaccagaagtgtttcggattttggagtttgtaagatttgggaatatttgcataatacttacagttgagcatccgtgatctgaaaatccaaaacgccacagtgagcatttcctttaagcatgacctttgcatgttatgtcagcattcaaaaagtttcagattttggagcacttgagacttcggattttcagattagggatactcagcctgtagtagcagtagaagtggtttgattagtgttatagcagcaccgagggataagaattaatctttatggccattccagttgtcattataaattcacagattgtcattataagttaatatacagatgatgcatagcaacaaatctgagtttgcttaattctgggtgtgtcaataaagtcaactttctggaaagacaaaggtaacagtagatacttaactgtttataacaattatagtttacattgtaatatttatatatacaatgtaattttataattatatatacaacataattttataattacaatttatagcaaaggaaatattttaaaaatactaatgtactcatttctttcgtcttttcgagtacatgaccttcactctagtttggctttgacatccatctgtgcggaggtggagatggggagtggggaggaaaggttttgcagatgtgtagtagacaaggtgtgtggcttgcaaatgctccaagagtgagtgacaggtgggtggaagtgtgtggaggggtgcctgttttgatgccggtcctgatatgtactggttgttgtatgctggcttctagcttgatgactcttgtctatatagtcacccagcactctgctggcctcaaatattgaagttgtggttgttgaaactgtgagcgttttccccgtcatctcctcctggccttaaatactggtactctgccatatcctccccatggtccctggcagtctactcccatcccttgctgcaaggcccaacatgacaggcccatggctatcaactccgtgtccaagccacatgagaactgagaggttcaagagacttctctctgttcaattatgttactcaaatctcttaagtcagcctgccttcctgatatatctcaggccttcccagtagtaattccttccaggaaatgcagaagtaaagcaagaataccctctttgccttccatgtttccctcaatttactgcattccaacccccctttccagacccaaagagggataatcaggacacacatcttgcagctctgattttctgtctctgtttatttttcctacatttcctatgaacaaattgggtgagctttgataatttcatcttcttgtctaaatctccctccaataaaactctccaccttcaaacctttgatttaacaaagagggacatgaaggagtacagacattcctatatctcaaagcagtaacctaacatgcaagactattagcccacttggcaattttattttaaatgtctaatgctaaatattctttccattacgttgtttctgtactaatgtctaccttttgttcaaataaatggatgcctcaagcaaacttggactaaagtcaggtagtcttcatagcaaaagagagaaataatgttttcaaataattaccttcattacactagtctacattgtgagtgttgaataacaaataccataaatgcattaaacattagtcagagctatcagcacttatatctttgatgtgatagagggaaaaaaagtgaaatctttttgccacctgcctgaaagtgcttgaagccaataacaatgcaaaggacttggatgaaagggctcttaggtgatttgggttgtatcttagactaggagagcttggttggagtccatttgtgtccattttagagctcgatcatttattcattcatttagatatttattccatgtgtatcaaaaatctacatatcagaaggtatgctaggcactaggaagttaagagtgaaaggacattaccacatattaagtaaagcagtgggctctatatgggggtcatagtagttcaacaacacttagtagtttagtcacctctgcccaaggtgaacgtgcccctcctctggtggcctcacctccagtcaggttccctccagttacatacccatatggacattccatatggatgactttttaaaaagacaaatgtgatcataccactcatctcccttacagtccctcaatgattctcctttgcttagaataaaaagcccgattttccatcaccccaggtccccgccacatgccatcactcaagctgagctgcaaaaactgaaagacaggctcccaacaggggctatggctgttaggaagaggctatgtagtcaatgttgctgctaagaaacaccttggtcttctagataaggtagttagaatgcttatatttttctccagtaattgtttttttctcttattaaaaaaatttctaacagaaagaacaacagccagagtttgagagcaattcactcggttacatttacttcgtagtctttatcatctttggctcattcttcactctgaatctcttcattggcgttatcattgacaacttcaaccaacagcagaaaaagataagtatctgggttgtcttgatttggtaattttatctctgtcctccaaatgcattaacaaaacataattctggcctagaatgttatacaaagtagcctttatgatctgcacaataacaaggagggagcctcccatgtctgcctggagatgatcctcaaagatgaggctgaaagaagactgaaaacatctgggtttaattaagtcattacttttattctcttttaccttcttaatcaatggacattgctactattgagatgaaacccattaataactgaaccctaatagaacaacaaccaccaggattagtatttattaaatatgacactagggtcatattttaataacctttcaaatgcactttattatccactataaaactaatatactctccttttcctgccagtgtgtcctggcccccagcacccaagcctcagcagatctatccaccctactcggaaagaagatgattggggaagaggcagggctagggaggttttcttccctatgcattgtaataaacacatgtttattttgctgattctaaaatccacaggagctttgtagtgaatgtggaaaatcaagataaaaagaaaatttaaatcacccaaaggtggccaccaaatgataaccactttagaccatgcctcttatgattttgatataatccattccagtcacttcgtattacttttacacagttaggattaccttatatttttaattttgtagttttgacctcattagttataagcttatgtcataaaattaactttgctataagaattctcagagcctctggcagggcgtggtggctcatgcgtgtaatcccagcactttgggaggccaaggcggggaaatcacttgaggtcaggagttcgagaccagcctggccaacatggtgaaacccagtctctactaaaaatacaaaaaattaaccagctgtggtggtacacgcctgtaatcccagctacttgggaggctgaggcaggagaattgcttgaacctgggaggcagaggttgcagtaagccgagatcgctccactgcattccagcctgggcaacagagcgagactccatctcaaagaaggaaaaagagaaaaaaaaaaaaaaggaattctcagggctgaattacattgcatattatggatagaccataatttatcctgatcattcccctctttggacatttataggttgtttttaaatttcttgctcttctaaaacaattatgaccatttttaaaattctgtgtatctctgattatttcttcagcataaattcctagaattacaatattaaaagcattgaagacatattgtcaaaataccttccagaaatgctgtgctaggtacccttattctgcagaatatgaaaatgcatggttactgagatctcatcattctaattgttatatatttattatcttttttagactggtggggaaagtattatctcattgttttatatttatttatttgatcattagtgaggttacacactttttcacaggttgatggccacaagtatttctcctttaagagttttttatttatatcatttgtctatttttaagtctgagattgcatttttatataagtccaatttgtgacatgcatcttatatttttgtaataacatatttaacttatagacattagtatttttcagagtcaaactcccaatcttgttatttttggcttttttttaattgtacttatgaactaaaggcatttctcaatccccaaatcaagtaactaaatattctcctttggttttcctaattgttttatggctttcttttatttttcctctggactctcataattcatccaaaatgtaccttgataccaattagccttcttagcatctgctgggaaagttgttccctgttgttacacaaactgtattgcttctgctactcaggagtgtgtgatgtagcatcctctctgtaatatgcatcttgattgctatcaatacctgcaatttggatgtcagtctttgtgattttagatttaagcttacattagaaatcatcgttttgaacaatccactatatccttttgttttgtcttgttttactttttattacagaaaatctcaaacatgcataagagtgtactagaattaacctaaaatacccatcacctagcacaacatttattgacttaagaatgtgcttgttctaagccatatacgcccttactcaactctgccaccagatttttttttatggagcaaaccacagacatcacatcatttgattcataaatattttagaacacatctctttttaaacataaccacaattccattagtacaccaaaaagtttaatgtgagttctttaaattcatcaaataccgagtctattttcaaattggtctgagcctttaatttaaaagaaaaatgtttatttattaattctgtgtttcatttgcttatttgtttctgttgaagctttttgtttgtttgttttcaaatcaggattcaaatacataaggtctttccatttgacaactttcttgttctctgaaatgccacgatgttccaagtttaggttgtacccttcctgccctagttctgtaatcagctatttctctaaaaactgtttgtttctttgtgggaaacggtttccaagaccacagtctagaatgctcattgtcattgtttctaagcctttctagtggacagagttgcttaaaattcaggactacaaggaaatatataagtggaaatttgcatactgattactcaaattcaggactacaaagttttcacttaacatctatatctccccctttccacactgagaaaccttattctcaaaggcaaagatgatagaatttaaaatttccacaattactcattttctttatctcacaacacacatacacacactacagtctcagaatagtggtattaatactactatgacatatatgattactaaaagactaatttcttcccagcatcccagaacaacttgattaatttttaggttgacttctagggctacatatttttatctgtgctggtggagtaaagtcaaaccccaaaccctcatcaaagtaagcctgaagtcacaaatgatcagggaagactggctttttactcatagtctggattgagacaattttctggttgtcttccattaccaacagacagattcgggtttttttctttacccttctgttggccacctttggatagtcccatattcttgcaaagacatctgtgcctctcctgtctttgcgtaggccttatttcccattacccccttacatttactaaaaactgagattctagtttacagagattagtaaatgttctaagaccagccatggctttgggctaatttactagtctatctttttgatctctcaattttcagacccccaatttttttcttacttttatgccagttcagctttacattttaaaagaattctgttctagtttatctagcctttctaaatattttgcccccaaatttccagatatgagaatcctagttcatttttctattctttcttgctcagtagtgaaaatagttagaacttttttttttccctgagagtggctctgaacagattttatgcagctttgttagtagtgttatgtgtattcattatttaagagaaattcaattgccctttatgagatgtttgtctaaatttttgtactaatttctatttttgttgcatcatggtttgatttatgcaagctgaaatatatcaaatttttgtaaagattctgtgtatatttgcgaagatttgtaacctttctgttctaaaaagtgaaaaataactgataaaggtaactttatttctcctgtataccttaacttaaatcttgtttctttacagcatttcgctatggtccagtctcttaagcttaccattgaaattttaagaattgttaatagaaatgtaatgtaactttaaaattgtgtcaaaaaattcagaactagattaaaaaaaaaactgttaaaggtaattagctcttatcttctccatatacttaggtggccaagacatttttatgacagaagaacagaagaaatactataatgcaatgaaaaaattaggatccaaaaaacctcaaaaacccattccacggcctctggtgagagcaattgaatgactgtaaatatgtagaacagttgagttactgtgaggaactcaaatttccgtaatgccatccttctttattcttaaaatttgcagacattaaggactcaacagaagtcaagacatattcaaacacttaggaaaattagatactcaaactcaaaagtaagagcctggacaacaacttaaatttatttttgagtgagccaggcaatatgtgcttaagtaaatacttattgcgaccatgtgaacttagtggtttgtttgaacttaattttgaccagtttattttattttatttcagtagtttttggggaacaggtggtttttggttccatgtgtaagttctttagtggtgatttctgagagtttggtgcacctgtcacccaagcagtgtacactgtacccagtgtgtagtcttgtattcctcaccctcttcccacccatctccttgattccctgaagtccattatatcattcttatgcctttatgtcctcacagcttaggtcctacttataagtgagaacatacaatacttgattttccattcctgagttacttcacttagaataatggtctccaactccatccaggttgctgcaaaggccattatttcattcctttttatggctgactagtattccatggtgtagatataccacattttctttatctgttctttggttggcaggcatttaggttggtttcacatttttgccgttgcgaattgtgctgctacaaacatgtggtatgtgtaagtgtctttttcatatagtaatttcttttcctttgggtaggtacctagtagtgagattgctgaatccaatagtagttctacttttggatctttaaggaatttccatactggttttcataatggttatactagtttatattcccaccaacagtgtaaaagtgttcccttttcaccacatccatgccaacatctattatttttttgatttttaaattatgataattcttgcaggagtaaggtggcatcccattgtggttttaatttgtatttccctgataattagtgatgttgagcattttttttctatgtttcttggccatttgtaaatcttcttttgagaattgtctgattatgtcttttgcctacttttggatagaattgtttttgtcttgatgatttgtttgagttccttgtagatcctgaaaattagtcttttgtcagatgcatagtttgtgaatattttctcccacctggtgagttgtctctttactctgctgattatttattttgccgtgcagaagatttttagtttaattaggtctcatttatttatttttgtttttgttgcatttgcatttgggttcttggtcatgaattctttgcctaagccaatatctggaagagttttcttgatgttatattctataatttgtatggtttcaggtcttagagttaagtctgatccatcttgagttgatttttgtaccaggtgagagatgaggatctggcttcattcttctacatgcaaattgccaattatcccaacacaatttgtgggatagggtgtcctttccccagtttatgtttgtttgctttgccaaagatcaattggctgtaactatttggcttttttggggggttctctattctgttccattggtctacatgcctgtttttataccagtaccatgctgtttcagtaactatggccttgtagtatagtttaaagtcaggtaatgtgatgcctccaaatttgttctttttgcttagtcttgctttggctatgcaggctcttttttggttccatatgaattttaagatttttttttctagtcctgtgaaggatgacggtggtattttgttgggaattgcactgagtctgtagattgcttttgacagtatggtcattttcacaatgttaattctacctatccatgagcaggggatgtgtatccatttgtttgtgtcattaatgatttttttcagcagtgttttgtagttttccctgtagagatctttcatctccttggttgggtatatttctaagtattttatttttttctgcagctgttgtaaaataaattgaattcttgatttgtttctcagcttggttgttgttggtgtatagcagtgctactgttttatgtacattgattttgtatcctgaaactttactgaatttatttatcagatctaggagctttttggatgagtctttagggttttctaagtatacagtcatagccttggcaaatagcaatagtttgacttcctcttttccaatttgaatactctttatttctttctcttatctgattgctctggctaggacttctgagtgctatgttgaatagaagtggtgaaagtgggcatccttatcttgtcccagttgtcatagggaatgctttcaaccattacctgttcagtatgatgttggctgtgggtttgtcataaatggcttttactaccttgtgctatgttccttctatgccagttttgctgagggttttatcataaagagatgctgaattttgtcaaatgctttttctgtgtctgttgagatgatcatatgatttttgtttttaattctgtttatgtgatgtatcacatttattgacttgcgtatgttaaaccatccctgcattcctggtataaaacctgcttgatcatggtggattttctttttgatatgctgttggatttagttagctagtattttttgagtatttttgcacctatagtcatcaggaatattggtctgtagttttcttttttgttgtgtcctttcctggttttggtattagggtgatactggcttcatagaatgatttagagaggattccctctttctctatcttttagtgttagtgtaaccacccttgccccctgcctagtcagagccaatttatcaagatgggggaattgcaatggagaaagagtaattcacacagagctggctgtgtgggagatgggagttttattattactcaaatcagtctccccgagcattcagggatcagaggtttttaaagataatttggtgggtaggggctagggaaatggggagtgctaattggtcaggtttgatatggaatcatagggggtcgaagtgaggttttcttgctatcttctgttcctgggtggaatggcagaactggttgaggcagattatgggtctgggtggtgtcagctgatccatccagtgcaaggtctgcaaaatatctcaagcactgatcttaggttttacagtactgtactgatgttatccccaggagcaatttgaggaggttcagactcttggagcccaggggctgcatgacccctaaaccttaatttctaatcttgtagctaatttgttagtcctgcaaaggcagactggtccccaggcaagagcaggggtcattttgggaaagatctattatcaattttgtttcaaagtcaagccatgaactgaattccttcccaaagttagttcagcctatgcccaggaatgaacaaggacagcttaaaggttagaagcagatggagtccattaggtgtgatttctttcactatcataatttcctcagttataattttgcaaatgcggttccataagtaggactggtaccaattcttctttaaatgtctgatagaattcagctgttaatccatctggtcctggacttttttttgttggtaatttttttattactgtttcaatcttgctactttttgttggtctgttcagagtttctatttcttcctgatttaatctaggatggttgtatatttccaggaatttatccgtttcctctggattttctaatttgtgcatgtatgtgtttgtagtagccttgaatgatctttcgtatttctgtggtatcagttgtactatctcctgtatcatttttaattgagcttattttgatctctcttcttttcttggttaatctcactaatggtctatcatttttatctttccaaataaccagctttttgtttcatttaccatttgtattttttttgtttcagtttaatttatttctgcttgatctttgttatttattttcttctgctgggtttggatttgcctttggcttgtttttctttctctaattccttgagatctgaccttagattgtctgtgagtgctctttcagacattatgatgtacgcatttaatgctacaaactttcctcttagcaccacttttgctgtatctcagtggttttcataagttgtgtcactgttatcattcagttcaaagaatttttaaatttccatcttgatttcattgttaacccaaagatcattcaagaggagattatttaatttccatgtatttgtatagttttgaaggttccttttggagttaatttccagtttttttccactgtggtctgagaggatacttgatatgatttcgattttcttaaatttattatgacttgttttgtgatctatcatatggtctatctccatgtgatatggagaatgctccatgtgctgatgaatagaatgtatattctgcagttgttgggtagaatgttctgtaaatatctgttaatttcatttgttctagggtatagtttaagtccattgtttctttgtttaatttctgtcttgattacccgtctagtgctgtcagtggaatactgaagtctcccagtattattgtgttgcctcattacttaggtctaatagtgattgttttatgaatttgggagctccagtgttaggtacacatatatttaggactgtgatgttttcctgttggactaatcattttatcattatataatgtccctctttgtcttttttaacttttgttgctttaaagtctgttttgtctgatgtaagaatagctactcttgctcacttttcatttccatttgcatggaatgtctttttccaccctttaccttaagtttatatgagtccttatgtgttaggtgagtctcttgaagacagtagatgcttggtttgtatccattctacaattctatgtcttttaaatggagcgtttaggccatttacattctacgttagtattgagatgtgaagtactgttctattcatcatgttagttgttgcctaaatactttgttgggttttttaaaattatgttgttgttttataggccccgtgagaattatgctttaaggaggttttgtttgtttgtttgttttgttttgttttggtgtatttcaaggtttgtttcataatttagaactcctttttgcatttcttgcagtgttggtttggtggtgatgaattctctcagcatttatttgtctgaaaaagactttatctctccctctttttatgaagcttagttttactggatacaaaattcttggctgacaattatattgtttatggaggctaaagataggaccccaattccttccagctggtaaggtttctgctgagaagttaactgttaatctgataggttttcctttataggttatctaattcttttgtctcacagctcttaagattctttccttcatcttgactttagataacttgatgactatgtgcctaggtgataatctttttgtgatgaacttcccagaagttcttcgagcttcttatttggttgtctagatttctaacaaggccaggaaagttttcctcaattatttcttcagataagttttatgaactttagatttcttcatcaggaagaccaattattcttaggtttagccatttaacataatcccaaatttcttggaggcttcattcattttttaaacttttttctttgtctttgtctgattggcttttaattcaaaagctttgtctttgagctctaaagttcttctacttgtcctagtctattgttgaaacttaccatggcactttgcatttccgtaggtgtttctttcatttccagaagttgtgagtattttttctttatgatatctatttctctggaaaattttcttatccatatcttgtattgttgtttaaatttctttaagtgggttttcacctttctttggtatctccttgattagcttaataataaatcttctgaattctttatctggaaattcagagatttcttcttggtttggatccattgctgagaagctagtatgatcttttggaggtgttatagaacctattttgtcatattaccagaattacttttctggttccttttcacttgggtagactattacttaaaattgttcttggatttatttttaattgaactgtgttttttaaatttaaaatattttccctctttaacatcaggacagtgtgtattttagcctaatttgattattggtgcttgtaggagtaaagactctgtatgagatccttagttataaagagtcattgtgcactggctttccctgatgctggttgtagtagttactgtcttagtgtgctggcaagttcactgtctcctatggagttggaatggcagggatctcttgcagcttatctggttctctcatggtgtacatttttatttatttatttatttattttttcccagtgttttatttactgacttgatgattcaggcttcaggccaatagagaaggtatccctgagtaggcattggctatggctaaggcaggtgggtaaatgtaatacccaacagtgggctgaggtcccagccttgatgaaggtggctgggagacctctcagttagatgcgctgaggttttatcagggtgaagagtagaagctacctcagctcctctgccaggtcagccagaaagctattcacctcacagcctcactcctatcccagtgttttggctgttcagatcagacagccacctcttttcatctgtaggaatgttgatgttccaagtagggaggaactgtgactctgcctctcacacagcctgaatctagggtgtgctccttctctggggccgcactcaccctggattgttccagacaggctgtctatagatgcctccatactgtgttcctgtgggggaagccccagctgtgtctgcagtgaagtgccagaggaaaacaaggacctcttttctaaggcccttcacaatcacagaggatgcctgcccattgggctagaggtgcagactttccctactgtgccagcactgcaattgtgtttctgctgtgagaaactacccaccagcagaaagatctggaactcaagacctgctcttcagattcttttgtcccacagggtgatcccctgatgtggtgcactcccccttccctagggatggggcttcctgaaagccagactgcagtattgttattgctcttctggttctagccacctggcagggctactaggctctggggtggtgctggggaatgtttgcaaagagtcctgtgatgtgatctgttttcaggtttcccagctgtggataccagcacctgctctggtggaagtggcaggagagtgaagtagactctgtgagagtccttggctgtagatacatttagtatgctggctttctcaaatgctggttatgctagcagtgaagttgtcacgtggacagactcaggacctctggttagtcaggatgttgcaggcagtagaattagctgtcgttttctccttcctgggatcagggctattctgtcatgaattgcagtcatgtcctgagttggttgacctccagccaggaggtggtgctttcaagagagcaccactgtgctattagcagtgggatatacgcttgccctaagttggccaggggaggtattctgactttcaggagacaggcagagccataaaactcccaagggtttatgtcttttgtgttcagctactaggacaggtagagaaaaaccatcaggtgagggcagggttaggcaggtccaagtgcagactctccttgagtggggcttgccataaccactgtgggggatgaggaagtggtcctcaggccaatgaggttatgttccagaggggattatggctacctctgctgtgcagtatagatcaccagagaagtgggggatagccagtagtgaaaggcctcgcccagctcccacacagttggtgaggctggtcttgctcctgcagtaccgtgctaactgcaccaagtttagatccaggcagcctactcagggatctcagacctgccccaggccataagcttccctgctgacaaagcaagcatggctttcaggccacatccctccctgtctgcccacaatgtcagcagctcctgcactcgtatctgcagcaactcccgttagccccctggattctgctcaaggaagtttgtgcccagtcgaaattatcacagaatctagttggaagtttctttcaccctatggcccctccttttatttggctggctgccttctcagaagacccctgtgagatacagtcaggaatggcattccagggcccaagctggagactgggagtaccttcaaggttcctgttgcttcttctacttttgcacttcatgcagctccctaaagtcatttcagctctaggtaaggttacaaccttctctcgtgatctgcattttcagattccccagtggggatgtgtgtttggaggcaggttttcccccctctcactcacactttgggaactcacggcttttcacctgtctcgtgcagtctgcagtggcatgtcacttctttcaaaggatctgtgaattcttctggttttcctgttacgttcctgcggtggttcttgaagcaaaagtccacagtgtgagtctccacacactgttctgtccatccaagtgcgagatgcacgttagccctgcctcctatctcccatcttcctgtttttgcttttttcaattttgatgagtttaaaatgtacttgtaatactttttaccagtttttattagtgtgaggttaaggtcatgcatacttacttccactttacaagtatttatgataaactttgtatatcagggattgacagacttttccttaaaggcccagatagtaaatatttcagtctttgctggctatatgtctctgtcatagtactcaactctgccattgtggtacagaagcagccatagacaatatagaacaaataaacatgcctgtattccaacacaactttatttagggacatggaaatttggattttatataattatcatatgtcgcaaaactttattcttcttttgattttttttttcaccaaacatttaaaaatgtaaaacccattctgagctcatgggctgtacaataacagataggtcactggatttgtcctataggccatggtttgctgatccctgtgctctatgaatcctgctttatcaggtactatggggcaagatagaagtagcatccagggcagctctgtgcttgcagtctaattgaggagctgagatgttgtatacatactttagagcattgggttataaagtagtacaataggcacaacagagttggtagctctgacaagtgagtttgaatgctccatagcagagcaggtcagtggaggctgaaaagtcagggaaagcaggatgaaagaagggcttgcaatcggaagcatgcagataatttggaggtttccatttgaacatgagatcgcaaatgatgaatgcagtctacttactgctattctcggcacccagaatagggcctggcataaaatgtgttctcagtaattatttattgaacaaaaaaatatgttttaaggcacaaacagagtccatcacactaaaatgaagtatttttgatgcactaaaaaagtcaatgaatgtcagggccaaggatttagaatttatcttttatatagtgagagatttttgaccacagggttaatgataaaattatatttggggaggtttaatctgccagcggtttatgggacttcagtttacctaaattgaatctagcttttaaataccaatctcactttctagtactaatttcactttaaaattcttacttgaacttgagccaacaacaagaaaagagagaatttttgtttacatatgcatgctatacaaccactgactcattatcagttggtcttgggtttggcattaactaaaagagtcacaagacacaatatgttctgacatatttatcagtttatttcaagcaacacagcacacagcccaacaaaagttgcaacacatagatgcactgcacagagcatgctaggctgcaagagatgaactgaaagtgggtgcagacaacattaacataggaaagctgtcacctccattccttagccatcttttatagcatgcttatcacatggcttatctggaagtaggtgcaaaatcacagctctccctgtgtagctacaactcaccaatcaagccttcaatgaatgattctggtaatcaaatacaatctcaccacctaacactgcacgtttatcttgacttttatattccagattagtgtcgcatgagataaatccaacatcatatcaccagaagtccctgagtctgggcttagactttaaatcaacagttagccattgacccacaactttatctccccagagattttttttccatctctaaaatccaaatattagcttttgaccctcgaaacaaacgaagagcaattgcataggtggaaaacatagctgttttagcctgagcattgatgcatttcatttccagtaatagaacaaggggtttggaatcacttcgatttctcctgaagcatcttcacagggtggcttcatttcttggtttaaaattcatactgaggtataggagtcacactgcgttctgaagtgacatagaatgctttttttgatcatccaacactttaggtaatccaacactttaggtaatttatgctcttaatctcctctatttgtctagatgttagagttaactataaaaccaatactcaccctccctcatatttctttttgcccttcattccgcttccctggagtgcaccttttctccagctcctttctgacttcccaaattcatgcttaaataggaaaggcacttgactttctagtgtcttctcctggctctttgataaaagccttggggctcccagcacatggttcgaaagtcacaactgaaatgtagtgtcctccagtgttgtccctaccctccttcctctcattgcccttgctctccccaagtgatatataattcactcccgtggttttaattcatatcagtattaatgtcatctgtattctagcttctgtacctgcactccaaactcatacttctacctgcccattgcccttggaccccccactggcacctcaactcaacctgctcaggtcagatcttatcatctctctttaatattcctcatcctctgttctctggctggttagatggttttatcaaccggaaactatattctcagtcttaactttctcaaagcccactacatttgaattctctgacggttcttgcttccacctcacattagctcttaagcctatatgcttttatctttatctgctgtcaccaccacaagccaacatcatctttgcctggattatataacagatcccttgggtgtctaaagatgtattcttaggagtatgtgagttctctaaagataatagtgtatgccactttgattaggtgataatataatataaaacaatatgtacacagattgtaaagcaaccaacgtatagtcaagaatgttataaaatttcaatgtctgaatttgtatttaggaatagttttccacaaagtgaagaacaaagtagtgcttcacagcagttgtattaaagaaaataatggaataattgagtaatttcactgcatatggtagacttggcatgcaaacttgagttaggacctgtacctgaacaatcagcatatactcactttttgggcagtatggccatctatatataaaccacatgtaaattcaccctcagttatagtataaattaatcatttttttctattttcagttttagtaattattggattataatctcatctattagctttatcttcaagtgaacaagaattttaaaattggcattgaagaattatttgaatacagaattttggttaagttctgattattgtgaattggcaaatggagcattgaagatactaattccattttgtccaacatacttatgtgagcaggtattctctgcactaatattgttgaagtaagaatacagaaacagataaaatatagataccaagattcatctttttattattaaatccaacatgcactgttttatttcagcaaagcacatcatcaatcacatcaaagttatgttgttactaagactttttaatattttttgttttaaaatggaattaaagctataagcccaagcacttaaaaccagttactaattacattttaatgaaaatatataaggcaagcctggggatttataagaatttcttgccctttgaaaagggtctgtgtatttttcaaggaactgctttaattgtaaggaaaaacaaattctgttgtatttatgttctttttattgtatgtaattttattcttgcattcaaaatgatttataatttcttttttttctcagaacaaatgtcaaggtctcgtgttcgacatagtcacaagccagatctttgacatcatcatcataagtctcattatcctaaacatgattagcatgatggctgaatcatacaaccaacccaaagccatgaaatccatccttgaccatctcaactgggtctttgtggtcatctttacgttagaatgtctcatcaaaatctttgctttgaggcaatactacttcaccaatggctggaatttatttgactgtgtggtcgtgcttctttccattgttagtaagtaaaatcagcagtcagagggactttaagaaccagaagtaagtttgtaaatcttatcattttttgaagtttgttcaaactatccacaaagcagaaaactgggccaagtgtactttctgaaagaatagacaggggtactaatgccattctctactgggaagttgctaggagatagagagtaatttctgttcccttaactcactacacaactgaaatagagttcaataatcatgcagctaatgtattcaatggaaatagacaaaattaaaatgactcagaagtttttgtggtggtaacctgatttattcagataattgagtcaaagttctacctttcctgtgcaactataagccctatgagcattttttagttttaaggatttactgcccatgttttttcctttgttcaaaatccacatgggtgccagatcacaattattgtgcccctgtggcactgctgtgccccctttcaacccctatacaaggccccatggcccactctagattgggctttcaagagtatatcattcagacaatcaaagctttttttctattctatatcccatgttaacttaaaccacagtgtgaactgtgcttgtctcagattctttgaccccgcttaccaaccagcctcattctctaatcagtatatttttcctaatcacacgcagggttaactaaaaggcttataaaagaatacaaaagaaagaaggttattaccatactccttcttataaaacacacacatacacacatcaactttaaaattaaattcttcatggctaaaccataagtgcttactctgggtttttgaagtctggttttaattaaactgttaacttgacattttataattatgtaaaactgtccaggagcccttctcatagttcaaaacacaatgaagacaaagaaaactgattttccaaatggaagcttttttgcgatctcagaaagaatgcatcaaacagatatattggatcaagatattttggttcctaatgctactgcagcattgcagatgtttcagagaacaacaacaaatatgctacagttcatagtgtgttctggtttctaagccatgatgttaatgtagataaagcttatcaatagattcttccatgagtttacagttaagtagacctttaatttttattagtcaattccaatcacaagtcttggtgaaattgacagcagcaaaaaaaaaaaaaaaaaaaaaaaaaagggctagaaaatggtggtcagatgtctggggaggccctctaagaactcaaagagcccttcctctgatgagaaaagagaagctcattcattccaacagctccttccatgcagtgccaggcatcatgcactttgcggaaatgtttctgacttttgtcctttgaacaactgcttggcaattgcagttatacatgctgtatggcatttgccccagtggatgagaaaatctacatattaagccaaataatactcagcggtaggattaatccatatattaatcctacttactaatgtggacagagttttatatgcctttgccaatatttctgccgtccaacgctttagcctcagtacttttccaagctctttcctaagtttttggagaaatgcaaaatgagtgtgagttgaaatgaatctctctctaggagttaacaatctagttgaggtattacggcttactcgtcttaaagtgccaaaaaaagatagggaaattaattgaacaccaaatcacatggtgcaaagcagaaatgagctcagagaaagaacagattactatgggcttgatcagcccaagaaatattcatagaggaggtagatcttaaatgatgggcctcctccagttgttgctgaattggcacttaagaaactttacatctttccagggttgactttccaattaaagtatgaattaaacttctttggcacaattgggtagtcagtgaagtatataatcaactagttctctttagtcattaggtgacagcagagcattctgctgcccatgaaccctaatagacccctagtgaccttacaggacactcaaggtcattaggggtcatgggcactcaaatactgcccatgacccctaacaaccctagaagactctcaaagcaagaacaaggccatgtctacacaagacaagcatgttccaaccattctataatgtttaggccaaaatgtgaattgtcttaaatccttgtatcacttgcctgcagagcaggcagggcgacattttaggtcaaatattcagctgtttgatcaaacctctgaaatgacatttatggggtttgcagcaacagagaaagtatctccaaattgtgtcccttcagctttttgagtttggatctcagaagtccttggaatgaggatgacaattatgaaagatccatgggcagcttcagcctaaaggtgagcattccaatgctaccatttccctctagccctacagacattgtggctctttcagcagataagctgtcctcacttgtagtagggctgtatttaaattcttctacacacaaatgtagaagaactgtatggcccttggaaactattttccaaattaagacacagataggtattttccctgatagtggtaaaagaaattcttagttttgtacataagctacaaagtattgataaaaagttggcccccataggattctgaggcaggagacaggctggatctgaaaccagtgtgccttctggaaacttatttacttttctccttctcctgaggtacaatgatttctaccttggaaaatcaggagcacattcctttccctccgacgctcttcagaattgtccgcttggctcggattggccgaatcctgaggcttgtccgggctgcacgaggaatcaggactctcctctttgctctgatgatgtcgcttccttctctgttcaacattggtcttctactctttctgattatgtttatctatgccattctgggtatgaactggttttccaaagtgaatccagagtctggaatcgatgacatattcaacttcaagacttttgccagcagcatgctctgtctcttccagataagcacatcagcaggttgggattccctgctcagccccatgctgcgatcaaaagaatcatgtaactcttcctcagaaaactgccacctccctggcatagccacatcctactttgtcagttacattatcatctcctttctcattgttgtcaacatgtacattgctgtgattttagagaacttcaatacagccactgaagaaagtgaggaccctttgggtgaagatgactttgacatattttatgaagtgtgggaaaagtttgacccagaagcaacacaatttatcaaatattctgccctttctgactttgctgatgccttgcctgagcctttgcgtgtcgcaaagccaaataaatatcaatttctagtaatggacttgcccatggtgagtgaagatcgcctccactgcatggatattcttttcgccttcaccgctagggtactcggtggctctgatggcctagatagtatgaaagcaatgatggaagagaagttcatggaagccaatcctctcaagaagttgtatgaacccatagtcaccaccaccaagagaaaggaagaggaaagaggtgctgctattattcaaaaggcctttcgaaagtacatgatgaaggtgaccaagggtgaccaaggtgaccaaaatgacttggaaaacgggcctcattcaccactccagactctttgcaatggagacttgtctagctttggggtggccaagggcaaggtccactgtgactgagccctcacctccacgcctacctcatagcttcacagccttgccttcagcctctgagctccaggggtcagcagcttagtgtatcaacagggagtggattcaccaaattagccattccattttcttttctggctaaaataaatgatatttcaatttcattttaaataatacttacagagatataagataaggctacttgacaaccagtggtactattataataaggaagaagacaccaggaaggactgtaaaaggacataccaattttaggattgaaatagttcaggccgggcgcagtggctcatgcctgtaatcccagcactttgagaggccaaggcaggtggatcacgaggtcaagagatcgagaccatcctggccaacatgatgaaactccgtctctactaaaaatacaaaaattagctgggcatggtggcgtgcgcctgtagtcccagctacttgggaggctgaggcaggagaatcgcttaaacctgggagacggaggttgcagtgagccaagatcgtgccactgcactccagcctggtgacagagtgagactctgtttcaaaaaagaaaagaaaagaaacatggttcaaattatatctaaacaaaaaagaataagaaacaaaaaacacattaaaattttaagttgtattttctatgtttctagatacatcatttttgtttgatattttcctgatgcaagtatgtggtttatcacatgtagctcttttgcatgctaaatgaaaattcaaaacttgccaataaatgaatagcttattgcagacattttttaccaacattaattattttgggtttgtttaaaacctagaggcacaatcttgacttgtcaattactaccctttcacaagctaccatctcagatatatatatatatataaattcaataaagctttctgtttgtgttcctttcaggtagtacactaatattccccttttgttcagtggttgtgtgagtagtggtttaaatgtggtgctttgcttgcaattaaagactagaaccagtggtgtatctgacaagtgtttaacaactgactgttcaggaaaaagaaagccatgctttatagcattcactaatctctgtggtgtgagtactcccattatggctgatttcaagctatcaacatgttactggacgtggagttgagaagagatgctcataataagttcttgagagctggctcaagctgactgcagcacatcacttgctgaaactgaaaagagagccccacttggctggttaagatatttgcagtgggcaccttggacagagagagtaccctcttagcaacacgtggggcacggggtgagagatccatagacatactgcttaaccagtgatcttagccatttgatgagccctatttacagttttggctgaatgtctgtttcaaagaaacacccagacctatcaaaagggcttgggagcaggaggagcccaggagttccctaaaaactggagatgccaagaggtcaaacaggcattaggctttcagtcccccaaaaggctgggcgaggggcaaagaacctacattgtgatcattgaggagtggaggaaaacctcatagagatagccctggaaccctgtatctcagacaggtgagaagaactgatgtgtctgtcagcagcctggagtctgaggtcgggccctctgacctgccccacactgcccagcaaagggaatggcagcactggatcctgtggtgggctgagaggtgattattttcagtgtgtaagatcttaccatgacttgatgtattcatttcaagggcctgagttttgtaggcagccttgtgctctgaagcattggtaaaaatagtgataatatcattatctaatatttatttagtggtttctgtgcatcaggcactggctaagcatttgtcatgaatgatctcttttgtacctcgtaccaacccaatgaggaagatataccccatttaaaaaggagaaaactgaggctcagagaagttgagtgacctgcatacagtcatgcacctggtggagcccgagcctgtgtgccatgatgggaaggggaagtgggtgggctcaggaccagggaagctttgagatgggctaccagggctcctgtgcaggactgggagggcc

The invention claimed is:
1. A method of treating pain in a human in need thereof, the method comprising administering to said human an antibody or antibody fragment that specifically binds a human Nav1.9 protein that comprises a mutation in SEQ ID NO: 137, the mutation being selected from the group consisting of:
I381T, K419N, A582T, A681D, A842P, L1158P, F1689L, L811P, R225C, A808G, V909I, R86G, T1609I and G481E; wherein
(i) the antibody or fragment comprises a human gamma-4 heavy chain constant region that comprises a Leu at position 189 shown in SEQ ID NO: 73 or an Arg at position 289 shown in SEQ ID NO: 73 and wherein said human comprises
(i) an IGHG4*01 human heavy chain constant region gene segment, or the human expresses antibodies comprising human gamma-4 heavy chain constant regions comprising a Leu at position 189 shown in SEQ ID NO: 73 or an Arg at position 289 shown in SEQ ID NO: 73; and wherein
(ii) said human comprises a nucleotide sequence encoding said Nav1.9 protein comprising said selected mutation in SEQ ID NO: 137.
2. The method of claim 1, wherein said mutation is selected from the group consisting of I381T, K419N, A582T, A681D, A842P, L1158P and F1689L.
3. The method of claim 2, wherein the condition is small fibre neuropathy, numbness, tingling, cramps, joint pain, decreased vibration sensitivity or abnormal warmth or cold sensation.
4. The method of claim 1, wherein said mutation is A808G or R225C.
5. The method of claim 1, wherein the constant region gene segment comprised by said human is a germline gene segment.
6. The method of claim 1 comprising, before said administering, selecting a human comprising said nucleotide sequence of (ii), wherein the human is the human of claim 1.
7. The method of claim 1, wherein the human has been determined to comprise the nucleotide sequence that encodes a Nav1.9 protein comprising said selected mutation and/or a Nav1.9 protein comprising said selected mutation.
8. The method of claim 1, comprising the step of determining that the human comprises (a) the nucleotide sequence that encodes a Nav1.9 protein comprising said selected mutation and/or (b) a Nav1.9 protein comprising said selected mutation, optionally, wherein the determining step is performed before administration of the antibody to the human.
9. The method of claim 8, wherein the step of determining comprises assaying a biological sample from the human for a nucleotide sequence encoding a Nav1.9 protein comprising said selected mutation.
10. The method of claim 9, wherein the assaying comprises contacting the biological sample with at least one oligonucleotide probe comprising a sequence of at least 10 contiguous nucleotides of a nucleotide sequence encoding a Nav1.9 protein comprising said selected mutation or comprising an antisense sequence of said contiguous nucleotides, wherein said sequence of contiguous nucleotides comprises a nucleotide sequence encoding said selected mutation, thereby forming a complex when at least one nucleotide sequence encoding the Nav1.9 protein comprising said selected mutation is present; and detecting the presence or absence of the complex, wherein detecting the presence of the complex determines that the human comprises the Nav1.9 protein comprising said selected mutation.

11. The method of claim 9, wherein the assaying comprises nucleic acid amplification and optionally one or more methods selected from sequencing, next generation sequencing, nucleic acid hybridization, and allele-specific amplification and/or wherein the assaying is performed in a multiplex format.

12. The method of claim 9, wherein said biological sample comprises serum, blood, feces, tissue, a cell, urine and/or saliva of said human.

13. The method of claim 1, wherein said human is indicated as heterozygous for a nucleotide sequence encoding the Nav1.9 protein comprising said selected mutation, optionally, wherein said human is further indicated as comprising the nucleotide sequence of SEQ ID NO: 138 or said human is indicated as homozygous for a nucleotide sequence encoding the Nav1.9 protein comprising said selected mutation.

14. The method of claim 1, wherein said human is or has been further determined to be substantially resistant to a pain or itching treatment.

15. The method of claim 1, wherein said human is receiving or has received a pain or itching treatment or has reduced responsiveness to a pain or itching treatment.

16. The method of claim 1, wherein said pain is neuropathic pain or inflammatory pain.

17. The method of claim 1, wherein said method reduces a symptom of neuropathic pain or inflammatory pain.

18. The method of claim 1, wherein said human has been diagnosed with neuropathic pain or inflammatory pain.

19. The method of claim 1, wherein said antibody or antibody fragment treats or reduces the risk in said human of neuropathic pain or inflammatory pain.

20. The method of claim 1, wherein the nucleotide sequence comprises one or more SNPs selected from the group consisting of rs33985936, rs78812474, rs72869687 and rs13059805.

21. The method of claim 1, wherein said antibody or antibody fragment is administered by inhaled, intravenous or subcutaneous administration and/or is comprised in an inhalable or injectable preparation.

22. The method of claim 1, wherein the human gamma-4 heavy chain constant region of the antibody or fragment comprises the amino acid sequence of SEQ ID NO: 73 or an ADCC inactivated version thereof.

23. The method of claim 1, wherein the human gamma-4 heavy chain constant region comprises 228P and 235E.

24. The method of claim 1, wherein the antibody or antibody fragment is human.

* * * * *